United States Patent 9,758,790 (MODULATING THE LEVEL OF COMPONENTS WITHIN PLANTS) - sequence listing, part 2

SEQ ID NO: 2323 - DNA, 4658 bp, Sorghum bicolor
  misc_feature: Ceres ANNOT ID no. 6091796
  misc_feature: Encodes the peptide sequence at SEQ ID NO. 2324
atgaacggcgccgggggcagccaccaccagcagcagcagcagaggctccggcagcagcagcagcagcaggcgctcctgatgcagcaggcgctgcagcagcagcagcagtaccagtccggcgtcctcgccgccgcggcagcggcggccatgacccaggtcgtgcccccggatcctcgcctcctctcgatctgctggtctgtgtgcgcattgggcggcagtaatgcgcgccgatctgcttgtgagcgtgggagattgttttcttgctttgagcatttttcttaggctgcctcgctgggttactggactttttttttttggtggcgggcgggctagcggcagcacaagttacagcttgatagattgggtttcttctagctcattttgtggtggaattggagcaagcgctgtcgctgcacaagtttgtctgctgattgcgtgttattgttgtttgtgatacgtttctagtcgcgtacgagatgcttgtgctactgcctctatctctatcgttgttgcgacttggaagaaatgttgttaataaaggaaggcgtttggatgtgatttcttggaagacggttactacgaataggaaggattgtgttctcactcccttcatgcttttagctaaagggatgctatttttttttcttttgtgcccccttttcttgtctttgcttgccccgtaccactagtccactacggtctacagcctattttcccatctatcatttgtatcggctgtggattgggtggtaacacaaactgatgacctgatctgttcgtgaatctagaatgtcgtgtgcatgcagttcgagcattctgcttaggttgccccgcagatcatttgggtgcggttttagtacatttattggtattttattttattggaataatgtagtctatacatcctgtactattattatctccagctttatgaagtctgttaagtgcattatattattcttgatagttagttgtgctctgacttttgttccttaagctaaggaatgaaaacaaacggcactgctgcatatgcaaagcggcattgttctagttcggaagagatgtttggtagtaattgtatgcaatcactgattctatggccaatgggatacaatatggctagaagaactgagtttatattctcttcacatttttagtacacaattgtactttattttgatttgcttgtcattagtgtgtttcacagtaagtgtagtacacaattgtactttgttttgatttacttgtcattagcttgtttcacaataagtgtagtacacaattgtactttgttttgatttgcttgtcattagcttgtttcgcaataagtatcttcttttttattttcttctatattttatattttgcagatggaacctatttccaatggcaaccttccacctgggtttgatccttccacttgtcgcagtgtgtgagtgctttcggtgttcttctctgttttcactttcatatgtgatttatagcttacttttcctttttccctttttatctgtgcaactatgttttccttttaaaaaattaaaaaacctgaagttttcaaaggtaacgaaagccaaatttacgtaaatgcacagtttcacatatatgctggtgctaaatctgtagctaattgcagttgcataatctagatacagtcttatagtacctaccttgaatttttatgcagttatcttctttctcctaagtatgattttaagtcatgatgatttgctgaataggtatgttggaaatgtgaaccctaacgtcacggagagccttttgattgaagttttccagagtgctggccttgtggaaagatgcaagctcatacggaaagagaaggtgaacttctgcagtcaatgtttaagatttggagcacatgtgatattgcatcagaaatggttgtatttaaatagtcctccaactttctgaaggcacatgtgattatgtgttgaaccaaaggttttatgaatgctagagaaacaccagtggttgatatatagttgtaacttgatggtaaatttttccagtatgctttatgctactgccgagaagtctcatgatctttctctggctgataatttcacagcatacatacttttttgagtcaattgcatttatctgatgagctttcactctttctgcagtcttcctttgggtttgtggactactatgatcgaagatctgctgctctagcaatcatgacccttcatggccgtcacatgtaagttctgttatactactttaaacaacacaaatttcagagatttaaattctggtgttctttattgtcgcaatccttacacagatatggacaagcaatcaaggtgaactgggcatatgcaagtacgcagagggaggatacatcaggtgagatattcttaaatttatatatatatattcttgttgtctctttcttttcatattataatacttgtttggttaaccgtgcccattgaattatttccagggcatttccatatttttgttggtgatttaagttctgaagtgaatgatgcaactctttatgcctgtttctcagcatatccttcttgttcgtaagtccttagttctttgtatcatgatggcatctatgacgagcttgacctacagcctatgctttcaaatggtgacttgtcattcaaatttcgcaatatgctatctcaaatctatatatttcttgtgctattgaatttaggatggtagagtttgggcactatgacttctctcttagcttctaccatttttgtttgtctgtagccttttagattttcatttgtatcatctatatgtgcagcgatgctcgagtcatgtgggacaacaaaactggacgctccaggggttatggttttgtctccttccgtaatcaacaggcacggacaatttggactttgcttccttggattttgcagaactgtcaccatttttattcgtgtgccttgacaccacagttcatttcttttcctattatttttgcatttaaatgtttggtactggtgaatttcccagtgcctgaattctgttaaaggcaatattatagtttaaattagcgaattgtttgcagagtactgctagtttaaagaaaacatgtgatgttaatttcccatggttcaaatttctattttttcttgacattttttgtgaaatgattttatgatgctatgttctgattactgtctaaattctaaaatgttcttgtgagatttcattggttgtgcacctgataaaactttatctggctccttttgtcatccatagttaaaattcaaactgtattgttttagtttgtatttcatataccatgcacatgaagtttgagtatgaactggcatttccattagcgttacacttgcttacttgtacgattctctttgctggtgcaggaagctgaaactgctataacagaaatgactggtaagcatgctatcagtgcctatgacaatattcactacttctttcctgcctgtagtctactgatatgcaatttctgaattttggaaactaatttgtaggaaaatggcttggaagcagacaaataaggtgcaactgggcaacaaagaacaattcagaagagaaaccagaaactgacaatcataatgcagttgtactaacaaatggtagctccagcaattcaggttagtgtttttgaatgatttcatgaccagaaaaacaacagttctttttaaggccgtcaactttaccatgtttatattaaactattggcatgagatgaagaacatgcaacataattagtgataacaatttgagccaataaggttgtttattatattctgcagcaacggatgcaagccaggatggaggaagtaaagagaacccagagaacaatcctgattgcactactgtatatgttggcaacctcggacatgaggtacaatgaaattgctgcacaaccactttcatcgtcccaactggttctagtttccagattttttcactgttgctagtgcctactgaaattggagtgaatgtgtttctcattactttttcctagcactctagactctagagaccattgagattgtagcaactatgattcatctttcacttaactggtcaggttaaccgggatgagcttcaccgccacttctatagcttgggggtcggggcaatcgaggaaatccgtgttcaacaggataaagggtttgggtttgtgagatatagcacccatggggaagcagcattagctattcagatgggcaatggattggtagtccgtgggaaaccaattaaggtaagatccaaagcattaatataaatgcctcctgcttacatgatcctttatataattgtttttatgtaatttttctaatggttttaactgctctgttctcttgtagtgctcatggggtaacaaaccaactccacctgggacaagttccaagcccctacctcctccagttgctccataccagcctgctgtagcaatgccaggtgtcccgcaaggtttcacagcagcagaacttcttgcttatcagaggcagcttgccttaagccaggctgcagccgggcagattgctggccagcatggtctcgcgggtcaggtttctgcaggtcttcttgctgctgctggttcccaggccctctacgatggctacccaaaccagtcatcagcccagcagcttatgtactacaactag

SEQ ID NO: 2324 - protein, 447 aa, Sorghum bicolor
  misc_feature: Ceres ANNOT ID no. 6091796
  misc_feature: Functional Homolog of  Ceres CLONE ID no. 115366 at SEQ ID NO. 381
  misc_feature (158)..(229): Pfam Name: RRM_1 Pfam Description: RNA recognition motif. (a.k.a. RRM, RBD, or RNP domain)
MNGAGGSHHQQQQQRLRQQQQQQALLMQQALQQQQQYQSGVLAAAAAAAMTQMEPISNGNLPPGFDPSTCRSVYVGNVNPNVTESLLIEVFQSAGLVERCKLIRKEKSSFGFVDYYDRRSAALAIMTLHGRHIYGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKNNSEEKPETDNHNAVVLTNGSSSNSATDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTSSKPLPPPVAPYQPAVAMPGVPQGFTAAELLAYQRQLALSQAAAGQIAGQHGLAGQVSAGLLAAAGSQALYDGYPNQSSAQQLMYYN

SEQ ID NO: 2325 - DNA, 2463 bp, Sorghum bicolor
  misc_feature: Ceres ANNOT ID no. 6094234
  misc_feature: Encodes the peptide sequence at SEQ ID NO. 2326
atgcggaaggcgtacagggactccatcaaggtgctcgaagctgacatccagcacgccaacaccctgtaagcccagctcttgcccgcctccctctttctctgcccgccctgattccggcgccgcctcacatctccctgttcgtcgattctgctccacttcactagtacgggcccgtgtccctctcgtttctctgtttggcctccgtggtcgagcgggtgcgtggggggtttccgcggggctgggtcgctggctcctctcggcctgctgccggggttgcgcaatgcggcggcaaccgagggtggtgggttgatcaatccagcgtccggttcgcccgccctccgctgggatccgtccgtcgtggtggttggtccggtgcctgttgttggttgcgctatccgtgcgcgcgcgcacgagcggcgaagcggcagtagatcaggagggaatcgcatgtgtttataggatgtttaaaaaagaaactctgcttcccatgtgtttcagcgttctaaattatatacctttttttcctgcttatataagaggaaaagggggcgagatgagtgcactagtgtggtctttaggtgagggttgccttattatctctgagtgcatgtgatctggcaagtgatgctagttgtttatctggatgagcagggcctccgagtttccccgggactatgacggtgcgtgtctgcagatgcggctgtcgtacagtcccgcagctcatatattcctcttcctggtgcagtggacagactgcagcctcgccggggcgcttggtctgctgagaatcctcatatacaaggtctgtggcatgctctgcttcacggttgttggttcagtgctcacattgtggatgtgctctcctgaatttgtagctcgttgttcaggtttatgtggatggcacgacaaccatgtcgactcatgagaggaaagcaagtatcaaagaattctatggtaagagtgcatgatgttcttacatctttgcctaactatgttgtcttttgtgctgcattgctgatcagaattgctatatgcttggcatgagcagctgtgatatttccttctttgctgcaactgcaaagggggatcactgatgtggaggacaagaagcagaaggccgtgtgcatggagaggtacacaaagaaagatgaggacgaacggggctccttatctgatattgatgtcgagagggaagaggagtgtgggatttgcatggagatgaacagcaaagttgtgctgcccaactgcacccatgctatgtgcctcagatgttaccaagactggtatgcgcacgattcagtttctgcccatgtgttttctgtgaatgcattgagtgctatattctcaaatttcaatcaccctacttttactgctatgcaagtgcaaacttattgggtgggctcttgttatcaattatcgattaaaaaccttctagctagatgattcatctatatcattcctccacctatctgtatcatggtaaggtagatcctgttaaacttgaactgctgagaacaatggctatagataagtttaaacttgtcttccttgttctttccagcaacttatatgcttgtaaacaagatggaacccctccgtgcatatgggcttgtacttcttttaatgaaaccttttggtatgaatggccaatagctcaacagaacatagtgctctgtgaaacagatctgtattcatttatatgctttcccattgtctacttcattctgaaaatgaagtgatcattggaaggtggcattgtgatattcatgtgaactacagtaagtaggcttaatgtggtgattagccaccagattctttttaactatcttctgccattccttagtgcaaagaggaacctgagtgtggtgccctgtcaagtattggtttttatttttggtccagtccatgaacataatcattcatcttatgtgtagactgtgcactctgtttacagcccattggttctaggctaagaagacacagcactcatttgttcacttaaacgaacaatttagctcattaaactacttgtgctcctgctgatcatagtagcttcatatgttagcaagccctgatgatgggtgtctactaggtgttcctatgatatttgtggtttgtctgtattcttttggccaatgtaactttctcaatcagcataacttggattgaatcgctgaatgtcctgtttatcaccattaagatagtgttgtttatgtttgccatagtttgacaataacattgcctttttacaggagttcaagatcgcagtcctgcccattctgccgcgacaacctgaagaagacctgtcctggtgacttgtggatctatgtcgaggaccaagatgtggttgacatggagacagtgtcaagcgagaacctcagacggctgttcatgtacataagcaagctgcctctgattgtcccagacgtcattttcagtgtttatgattcccacataaaatga

SEQ ID NO: 2326 - protein, 242 aa, Sorghum bicolor
  misc_feature: Ceres ANNOT ID no. 6094234
  misc_feature: Functional Homolog of  Ceres CLONE ID no. 156298 at SEQ ID NO. 490
  misc_feature (146)..(183): Pfam Name: zf-C3HC4 Pfam Description: Zinc finger, C3HC4 type (RING finger)
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMERYTKKDEDERGSLSDIDVEREEECGICMEMNSKVVLPNCTHAMCLRCYQDWSSRSQSCPFCRDNLKKTCPGDLWIYVEDQDVVDMETVSSENLRRLFMYISKLPLIVPDVIFSVYDSHIK

SEQ ID NO: 2327 - DNA, 2463 bp, Sorghum bicolor; identical to SEQ ID NO: 2325
  misc_feature: Ceres ANNOT ID no. 6094234
  misc_feature: Encodes the peptide sequence at SEQ ID NO. 2328

SEQ ID NO: 2328 - protein, 242 aa, Sorghum bicolor; identical to SEQ ID NO: 2326
  misc_feature: Ceres ANNOT ID no. 6094234
  misc_feature: Functional Homolog of  Ceres CLONE ID no. 99033 at SEQ ID NO. 1165
  misc_feature (146)..(183): Pfam Name: zf-C3HC4 Pfam Description: Zinc finger, C3HC4 type (RING finger)

SEQ ID NO: 2329 - DNA, 4565 bp, Sorghum bicolor
  misc_feature: Ceres ANNOT ID no. 6094284
  misc_feature: Encodes the peptide sequence at SEQ ID NO. 2330
atgcaccagcccagagcccgctacccgcccggctatggctccggcggcggaggcggagccgggcgtggcggcggaggcggcaatggaggcggcggcggaggcggtggcggaaaccacaactactacggccggaacccgcagccacagcagcaacaccaccaccaacagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccataggctcgaggtactgcttttgcttatctgcacatctcctctggtgaaccatatttgtatactctgcttggtgctctggcgatctctagggtttgtgctttgtttttagatgtagaggcgacaacatgcggggtgttggagtgattttggttgcttcactggttaaatttgtcctactgttatatcatgctgacgtgagttaatgagcttgctgttgttgactattctttgattatgtcaggtttctggaaaaaaaatacaacaattgctgtaaaaatgactatcactgttgtaaatttgatctgcatttgtatattttttttgcccttcatcttgtgttttctatgtataaagtgtgtgattttgacatttgtttacccgtcgctgctattctctacttacctgttatataaatgattcacttgggactgtattgtattcagcactagcatgtcatgatgctaattaaactttatctattactagcataatcaatgagcttttcatttgtttgtttcagttctcatgattggaaggctcaactaaatataccagctccagatacacgctacaggacagaggtgagttctctttctaatacttattatccttctgtgttcaagtatatatgcacaatgcatccttgtccctttgaatggtttcagagtagtttttgagtggctcttgttttcttttacttctacaagctattgatagtttgcctctgatatttgtgttgtcgtacacaggatgtcactgcaacaaaaggcaatgagtttgaggattatttcttgaaacgtgaactgcttatgggaatctatgaaaagggatttgaaaggccatctcctattcaagaagaaagcattcctattgcgctgactggaagtgatattcttgcaagggcgaaaaatggcactggaaaaactgctgcattttgcattccagcacttgaaaaaattgatcctgaaaaaactgctattcaaggtgaactattctttcatatgttcaaattggaagtaagcatatggggtcgtttatttagttgctgcttgcttgctaccataacatgagcaacttaactggccaccaaaaaaaaaaaagttcctgtttcaccaattactctatgtatccatttctgctctatttatgttgcaagcccactgaattattgttattactttggtcaccttaatgattctgatatggtgaatgaaccagttccttaatctgtctttttgtatgtatattagataaatccacattcttgaaattttggtgtgttgtttttattgacgtgagaaataatcacaaaaaaagtttggtactgatactagtaggtatgaaatgtagattttttttgtggagaagcagaccatttgcacttagcattctatggctgtttgacagactgaatttgtaatagtgcaacaacattctactttctttgttgatcagtgtgccttttcaaaaacatgtgttatggatgatgtttatgtagtgccagttttacatccactggtgaattagttcattgttgtgtttcatggagtctcttatttttgttttctggttctattggtctttcttcagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggatgaggtataaataattacactttttttttcttgtgctgtatatattttatcatagcttagtcactggagtgtgtccttttcacaagtttctctcccccatttgatttacactaaatcatgtcactttgctatatgatgttgtgttccctcactgaaagaaaagaatctgaaggtttttttgtatctcttttcaaaattttactgtgatgttggccgcccttctgcatatgttcctgatgctaacattggtcttgataatgcacacttgttggtacactgctcaaataacattccagaaccatgttgttcttggagtcttatttcttaatttctacaatttgctgatttgtggttttgtgggtgcatttgtgcctttaaagtgtgttcatggtttgtatttgataatccatagtgctacaagctcatgtggggtttcagctctagcctttccaatttggttggggctaaaaggctttgttgttgttgtcttgttgatagtgttaggcagtcccaacgcgacactacctctagtttccatggcattaattagcttgccatgtaggcagaaaagctgacatggaatgagattagatgagtaaagagaaggaaatcagatgaaatcgtttcctatttgagaaacagtgtcggctcaagctccaaagtgtgaagaaaccggcgattttgcattggagacaaggagacgtttcctcatgtgggtccacagccacacctcgtcggtggtagctgctcgctaaccgcgagcctgttgcgcgcaccttgctgctcctgttcttgccgctggtcactgctcgctctgtgcgtgcctcgccaccagctgctccttgccagagcgcacgcctggccacgctcagcagccatgcctcgccggtggcctctgctccgcagccatgtcttgcaggcgactgctgctcgccacgcatgcgtgcctcgctgctggctgctgctccttgcgctcactgctgccccctgcatttgcgttgtttttcgatctgagtgagagaagaattgagtcatcctggccaaggagcagactcgagaaaaggaagaggatgcccatatgcagactggaacaatagggaggaggagcccacgtgaatgaagaaaaaggaagaagggacccacgtgaatatttctcgggtgtgtggtatagtttctatctgtactttcttggtgatgtggcagttatagaaactacccggtagtttcagggttgggactgcccttagtaactttcgaagtccattattgttgcttctgcggtgatctgatgtggatgttgcatccatttcgtatgttaatatgtatattatctgtcaaaagttacaagttgaacaaacacattatttgggatatcatgcaggcagacaagctattagctccagagtttcagccttctgtggaggcacttattcatttccttccacctagtcggcaactgttgatgttttcagcaacttttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaaggtacaacaaacattaactatacattttctgtttcatccacagttaagtgtaaactgacacatttccttttttgtgtgtgtgtttttgtcagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacaggtctgtactgatattttccttagtagtctttctcaatttagtaacttacttttcagcatatgttcaattgtcatttatgaaggtttctataagagtatcatggctctctttgttgcagatctgtttaccagaggaattgatatccaggctgttaatgtggtcattaattttgactttcctaagacatctgagacatatttacacagggtgcctttttttaatcttttcttctgtagaagctgtttattttataaccttccgaaatttaaaatttatgtgtgtgttgtcatgttcctaggttggccgttctggaagatatggacaccttggtttggcagtgaacttgatcacttatgaggaccgtttcaacttgtaagcctgcgttaataaaatggcctgtttctctagtcttacatcaaaattccttatccttttgtccctttgttttgcaggtataggattgagcaagaacttggaacagaaattaagacaatacccccacagattgacctggccgtgtactgccaatga

SEQ ID NO: 2330 - protein, 507 aa, Sorghum bicolor
  misc_feature: Ceres ANNOT ID no. 6094284
  misc_feature: Functional Homolog of  Ceres CLONE ID no. 534281 at SEQ ID NO. 938
  misc_feature (157)..(323): Pfam Name: DEAD Pfam Description: DEAD/DEAH box helicase
  misc_feature (389)..(465): Pfam Name: Helicase_C Pfam Description: Helicase conserved C-terminal domain
MHQPRARYPPGYGSGGGGGAGRGGGGGNGGGGGGGGGNHNYYGRNPQPQQQHHHQQQQQQQQHVHRNSSHQQQWLRRDQAPAVAGAASGNAAAKTAPQLDAIGSSSHDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 2331 - DNA, 4541 bp, Sorghum bicolor
  misc_feature: Ceres ANNOT ID no. 6094287
  misc_feature: Encodes the peptide sequence at SEQ ID NO. 2332
atggaccagcccagagcccgctacccacccggctatggctcccgcggcggaggcggagccggacgtggcggcggaggcggcaatggaggcggcggcggaggcggtggcggaaaccacaactactacggccggaacccgcagccacagcagcaacaccactaccagcagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccatagactcgaggtactgcttttgcttatctgcacatctcctctggtgaaccatatttgtatactctgcttggtgctctggcgatctctagggtttgtgctttgtttttagatgtagaggcgacaacatgcggggtgttggagtgattttggttgcttcactggttaaatttgttctactgctatgtcatgctgacgtgagttaatgagcttgctgttgctgactatcctttgattatgtcaggtttctggaaaaaaatacaacaattgctgtaaaaatgactaccactgttataaatttaatctgcatttgtattttttttggtccttcatcttgtgttttctatgtataaagtgtgtgattttgacatttgtttacccgccgctgctattctctacttacccgatatataaatgattcacttgggactgtattgtattcagcactagcatgtcatgattgtaattaaactttatctattactagcataatcaatgtgcctttcatttgtttgtttcagttctcaagattggaaggctcaattaaatataccagctccagatacacgctacaggacagaggtgagttctctttctaatacttattatccttctgtgttcaagtatatatgcacaatgcatcctggtccctttgaatggtttcagagtagtttttgagtggctcttgttttcttacttctacaagctattgatagtttgcctctgatatttgtgttgtcgtacacaggatgtcactgcaacaaaaggcaatgagtttgaggattatttcttgaaacgtgaactgcttatgggaatctatgaaaagggatttgaaaggccatctcctattcaggaagaaagcattcctattgcgctgactggaagtgatattcttgcaagggcgaaaaatggcactggaaaaactgctgcattttgcattccagcacttgaaaaaattgatcctgaaaaaactgctattcaaggtgaactattttttcatatgttcaaattggaagtaagcatatggggtcgtttatttagttgctgcttgcttgctaccataacatgagcaacttaactggccaccacaaaaaaaagttactgtttcaccaattactctatatattcatttctgctctatttatgttgcaagccactgaattattgttattactttgatcaccttaatgattatgatatggtgaatgaaccagtcccttaactctgtctttttgtatgtattagataaatccacattcttgaaattttggtgtgttgtttttattgacgtgagaaataatcacaaaaaaaagtttggtactgatactagtaggtatgaaatgtagattttttttttgtggagaagcagaccatttgcacttagcattctatggctgtttgacagactaatttgtaatagtgcaacaacattttactttctttgtggatcagtgtgccttttcaaaaacatgtgttatggatgatgtttatgtagtgccagttttacatccactggtgaattagttcattgttgtgtttcatagagtctctcttatttttgttttctggttctattggtctttcttcagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggacgaggtataaataattacactttgtttttcttgtgctgtatatattttatcgtagcgtagtcactggagtgtgtcctttccccatttgatttacactaaatcatgtcactttgctatatgatgttgtgttccctcactgaaagaaaagaatctgaagttgttttggtatctcttttcaaaattttacactgatgttggccgcccttctgcatatgttcctcatgctaacattggtcttgataatgcacacttgttgatacactgctcaaataacattccagaaccatgttgttcttggagtcttatttcttaatttctacaatttgctgatttgtggttttgtgggtgcatttgtgtctttaaagtgtgttcatggtttgtttttgataatccatagtgctacaatctcatgtggggtttcagctctagcctttccaatttggttggggctaaaaggctttgttgttgttgatagtgttaggcagtcccaacgcgacactacctctagtttccatggcattaattagcttgccatgtaggcagaaaagctgacatggcatgagattagatgagtaaggagaagaaaatcagatgaaatcgttttctatttgagaaacagtgtcagctcaagctccaaagtgtgaagaaaccggcgattttgcattggatacaaggagacgtttcctcatgtgggtccacagccacacgccgtcggtggtagctgctcgctaaccgcgagcctgttgcgcgcacctcgctgctcctgtgcttgccgctggtcactgctcgctctgcgcgtgcctcgccaccggctgctccttgccagagcgaacgcctggccacgctcagcagccatgcctcgccggtggcctctgctctgcagccatgccttgcaggcgactgctgctcgcgacacatgtgtgcctcactgctggctgctcctccttgcgctcactgctgctccctgcatttgcgttgtttttcgatctgagtgagagaagaattgagtcatcctggccaaggagctgactcgagaaaaaggcagaggatgcccatgtgcagactggagcaatagggaggaggggtccatgtgaatgaagaaaaaggaagaagggacccacgtgaatatttctggggtgtgtggtatagtttctatctatactttcttggtgatgtggcagttatagaaactacccggtggtttcagggttgggacttcccttagtaactttggaagtccattattgttgcttctgcaatgatctgatgcggatgttgcatccatttcgtatgttaatatgtttattatctgtcaaaaggtacaagttgaacaaacacattatttgggatatcatgcaggcagacaagcttttagctccagagtttcagccttctgtggaggcacttattcatttccttccacctagtcggcaactgttgatgttttcagcaacctttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaaggtacaacaaacattaactctacattttctgtttcatccacagttaagtgtaaactgacacatttcctttttttttgtgtttgtttttgtcagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacaggtctgtactgatattttcctatcttagtagtctttctcaatttagtaacttacttttcagcatatgttcaattgtcatttatgaaggtttctataagagtatcatggctctctttgttgcagatctgtttaccagaggaattgatatccaggctgttaatgtggtcattaattttgactttcctaagacatctgagacatatttacacagggtgccttttttaatcttttcttctctagaagctgtttattttgtaaccttttggaatttaaaattaatgtgtgttgtcatgttcctaggttggccgttctggaagatatggacacctcggtttggcagtgaacttgatcacatatgaggaccgtttcaacttgtaagcctgtgttaataaaatggcctatttctctagtcttgcatcaagattccttatccttttgtccctttgttttgcaggtataggattgagcaagaacttggaacagagattaagacaatacccccacagattgacctggccgtatactgccaatga

SEQ ID NO: 2332 - protein, 507 aa, Sorghum bicolor
  misc_feature: Ceres ANNOT ID no. 6094287
  misc_feature: Functional Homolog of  Ceres CLONE ID no. 534281 at SEQ ID NO. 938
  misc_feature (157)..(323): Pfam Name: DEAD Pfam Description: DEAD/DEAH box helicase
  misc_feature (389)..(465): Pfam Name: Helicase_C Pfam Description: Helicase conserved C-terminal domain
MDQPRARYPPGYGSRGGGGAGRGGGGGNGGGGGGGGGNHNYYGRNPQPQQQHHYQQQQQQQQHVHRNSSHQQQWLRRDQAPAVAGAASGNAAAKTAPQLDAIDSSSQDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 2333 - DNA, 3683 bp, Sorghum bicolor
  misc_feature: Ceres ANNOT ID no. 6099734
  misc_feature: Encodes the peptide sequence at SEQ ID NO. 2334
atggccatcaactcgctgagcatggtggaggccaggctgccgccggggttcaggttccacccgcgggacgacgagctcgtgctcgactacctcgccaagaagctcgccggcggcgccggagtcggcggaggcccgctggtggtgagcatctacggctgccccgccatggtcgacgtcgatctcaacaagtgcgagccctgggaccttcccggtatgtaatcaagcaagacgacctacaactacaccttgttcctgcatcattttgtacgtacatatgcctgcctgtccttatattaatttctgggggaagatcgatcgagtttttgcctttgtcaagtctttaattgcgctgcgaattattcttcttcttcttccttccttttgggtgttttcccttttcccctctgtgagaacactattcttccctttgggctctgatttgttattatgttatgtgttcctggtgaccaatgattgatctctctcaaataatccttttgtgctaatcaaaatttttaatgagagagatagcagtcgtacgatctgtgatccgttccgacatatatacaagtctacaccacaaatatatcatccaagatacgcttgctgatcacatctgtttgtaacaagggttgccaatcatgcatgcccatgtcctgctgttggctctcatcgatctacaagaatatgtataagatcttaaaataaacccagccataccttctctccattattagctagctactagtagtcatctattccaaggaaattctctttgttcctttcgcctgcatctctgcatgtttctccttcaaatggcacaaaaagtatacatacacctagctatatatgtacttcgattcgattaattgcgcgccaccgaaaatctaagatgcatgaataaccacaagtagtgtactgcatgctagttgaaactgtcccactccgagccataagtgaagcgaccatgacatcctcctcctgcaactttcaccgatcaacttgcaacagatagatgcaactatgcactactcatcccatacctcaagaatcccttacttttctttccttcaatcgtcgcttatccctttctttttcaccctctttttggggtgtgcccatgccatcggttttctttttttggagcatttataagctgctatatttatgggacacagtcacacagctcccttcttttgaaaagtctttgatgatctaaaggcataaacaaaaccatagtcagaccatctcgatgcaaatatatatttatgtgtgcaacaatagttgaggagagacagtttgcaagaactctctctcaaatccttgcatgtattctgtttttaaaaaagaaaagttcagctggatcggtactctagctagctgtgtttaagctatatatgcatctacaaaatctactgagagctaaattcacacgtcttgtctgcctccttgtcgccttcctttgccccatataacagaaggatattctcactgcctagagtttgtttggccccatcttggccttctatcctcatttgtccctgttcctgccatgctatcaaatattctctcgctttgcctcatccttaaagggaattaacagccaaatggatggggacaaacaccaaaagaaggcctctcactttgctaccagtagaatactgcggcaaaaaaccttgtcaaaatagattaagataatcaattgataaagaacatattgttttttcttcctaataactcttcttttatccatttctccccattattacactaataacaaatacatgttgggctctggtttagcacagttttttagtctataagatcaatgattaattgtgtttgattgtacgtgtctttatgtttacatctaataaccaaatgtgaaaatgatttacacagcagtgctatatattaactatcattaacctcgtttgctagtttattaactaactgattttcccctcaaattcagaaatcgcgtgcattggtggaaaagagtggtatttctacagccttagagatagaaagtatgccaccggccagcgtacaaacagagcaactgattcaggatattggaaggccacggggaaaagaccgtccaataagccggaaaagggttacttgttggtatgcgcaaaactcttgtgttttatcaaggtagagccccaaaggggaagaagaccgagtgggttatgcatgaatttcgcatggaagggcaaggtgatcccatgaaattacctttcaaggtaatacaacgacttgatttcactatagtgtgtccttttttttagttggacgtgatagtttattgcataattttattcacaattttcccatctgatggatataaaaaaatacatcatatatattctagccaatgagcaatatataacacatatacaaagtaggaaaatgatttattagggggtaatgaaaaacaatggagttggccccatcggttttcctatggataaactatggttgtgatgaaatcatcaagagcatccgcaattttcattctccaaaaaatggtgatcatatgagaagtatatatcaaagattttgaggagtacaatatatctgtgtgaactaaaaaagtacatacataatttgttcatgacacttgaggacgaagcttgtactatatatatgcagacactttttcttcattcatgtttgcatttgcataatcacatggaatgccagctcattctacacacatgtatcctctcgcctattcaagagagcgagaaaggcacaagcgcaaatttacagtcaagttgacaaattacttagttcttagtgttaccagttcaattgtgtgttggagaataaataaattaaagtaaagacgtatacatggttttggattaagatatcacacttcaatcgctacattgtttactgttaaaagaactgatggtcatagtattgtattaatgctaattaagagctttactttttttttgtacttgtgactttctttactactcaatgacttgtcactgtcatgcacagcaggttttctctaggcattgatatctcccatctatttccattcattttatatataacagtatatcacacacacactgcacacatacatactcttccttaaaaacaaataaatacttatcatgacttcttcacaatgtataggatacatgtacccatttacttattattatctatattggcctaatcctcatctgatttttttcatatataataattcacaggaggactgggtcttgtgtagagttttctacaagagtagggcaacagttgcaaagccacccacagagagtagcagcagcttcaatattgatgctgccacaacttcattgcctcccctcattgacaacaactacaatatttcctttgatcagcctggctcatcagtgcaaaacctagagggttatgagcaagtgccctgcttctccagtaacccctctcagctatcgtcatcgataaacgctccgctgtcgtctgccgccaccatggctgatccggagcaacacatggggaagtcaataatcaaggatgttctcatgagccagttcagcaggttcgaagcaggcaacgtcaagagggaggcgcctcaaagcaatttttctcaggatgggtttgagtacttagctgagagtggattcacacagatgtggaattctttcaattaa

SEQ ID NO: 2334 - protein, 294 aa, Sorghum bicolor
  misc_feature: Ceres ANNOT ID no. 6099734
  misc_feature: Functional Homolog of  Ceres CLONE ID no. 205648 at SEQ ID NO. 555
  misc_feature (13)..(137): Pfam Name: NAM Pfam Description: No apical meristem (NAM) protein
MAINSLSMVEARLPPGFRFHPRDDELVLDYLAKKLAGGAGVGGGPLVVSIYGCPAMVDVDLNKCEPWDLPEIACIGGKEWYFYSLRDRKYATGQRTNRATDSGYWKATGKRPSNKPEKGRAPKGKKTEWVMHEFRMEGQGDPMKLPFKEDWVLCRVFYKSRATVAKPPTESSSSFNIDAATTSLPPLIDNNYNISFDQPGSSVQNLEGYEQVPCFSSNPSQLSSSINAPLSSAATMADPEQHMGKSIIKDVLMSQFSRFEAGNVKREAPQSNFSQDGFEYLAESGFTQMWNSFN

SEQ ID NO: 2335 - DNA, 2047 bp, Sorghum bicolor
  misc_feature: Ceres ANNOT ID no. 6106161
  misc_feature: Encodes the peptide sequence at SEQ ID NO. 2336
atgcgcaagtttcaggactccgtcaaggccctccaggccgacatcgatcacgccaatgagctgtgagtcctgggagcagagtttcctgttcgcccccctttgcttgctcgagttaaaggcggaatctttgtctacttttcgacgttttggtgcctgaattgcttgcttgcgttttttttcttttttgttgctgcggcgagcagggcgtcggaattcctgagggactacgacggctcggtcatccagatgcggatggcctacagcgccgtcgcgcatttcctcgtgcagtggaccgactgcaagctggccggcgcgctcggcctcctcaaggttatgctatacaaggtattgcctcgcacccgtggttcgattcggttttcacgccgcgagctgcctgctgagttgccccgtttctccggcaggtgtacgcggacgactcgtcggcgcttcctgactgggagagggaggccagcatcagggagttctacggtaattaacccaccccccgtttcttcccatctagcaagccgtgaagaattgtgccgctgagtgtcggttctgacggcgtagcgcaattgcaggcatcattttcccgtcgctgctgctgctgccgagcggcatcaccgagctggacgacaggaaacagaggaaactctgcctgaagaaattcaggagcagggatgagcagctctcggaggtggacacggagagggagctcgagtgcgggatctgcctcgaggttagccgcaagatcgtgctgcccgactgtgcccacacgctctgcatgcgctgctttgaggactggtatagctccttttctcctagcttaaaatcattagccgaatccataaacatgcaggaaggctgatttttttttgggtatttattagtacatttgcactgatttggtcatgttagcttatggatggcaaagtattaattctcatgccttctgaagcagaattacagtcaagtagttctcgaaggttctgaagcataattacagtcttgtgaatgttgtttgaaactttgtattgggaaacgtggcaaatttgtttttagtgaaattatatttctttatgtagtgctatttttttttaaaaaaaaaaattagtgtcgtgctttttttctgaatgaaacaatttcagtgtaggtggtctcttaggaaccttgttagtgttgttagatggtctgtctctagatctctagtcatttgacagaattccatgttcttgatgcaagctgttcgtccaagcaacttgcaatgataattccattattatgctaggaaagagtaggaagctttctatcgaatcagtagtctgtttccgaggcatcactttcattttggttgcatgatgactctcgtcagaacagcaaacccctgctactttgtgttttactataccgtgggtgtatgtaccttcaatatttatgctcaccttgaggttaaagattcaagttatagttttttttttggtgaaagtattcatggtatagttggttagtagcagatgaagtggtctgataaaatgtgatatgctcagttaatgattgttccattcagcttatctctttgttgagtcaggatatgcttcgctctctcatgccaatgtttatcttccactggatactttgtgctttgctctctaatcttccactctcttgagccaatatttaacttccactggatattttgtgctttgcatcttcatcaagcataacaaatctctccttcccttccctactcggctactcccaatctatcattcactcaaacaaatttgtatggaagctattacaagtgatcatcctattcactctgtattgcaggaacgagaaatcaaagtcctgccccttctgtcgcgcctgccttgaggaggtgaagccaggcagcctgtggatgtacactgacgacagcgacgttgtggatatggatactttgactagggagaacattaggcggctgtttatgtacataaataagttgccacttgtagtcctacatgtagttgaccttgacatttacgagtaccgcatcaagtaa

SEQ ID NO: 2336 - protein, 235 aa, Sorghum bicolor
  misc_feature: Ceres ANNOT ID no. 6106161
  misc_feature: Functional Homolog of  Ceres CLONE ID no. 99033 at SEQ ID NO. 1165
MRKFQDSVKALQADIDHANELASEFLRDYDGSVIQMRMAYSAVAHFLVQWTDCKLAGALGLLKVMLYKVYADDSSALPDWEREASIREFYGIIFPSLLLLPSGITELDDRKQRKLCLKKFRSRDEQLSEVDTERELECGICLEVSRKIVLPDCAHTLCMRCFEDWNEKSKSCPFCRACLEEVKPGSLWMYTDDSDVVDMDTLTRENIRRLFMYINKLPLVVLHVVDLDIYEYRIK

SEQ ID NO: 2337 - DNA, 2772 bp, Sorghum bicolor
  misc_feature: Ceres ANNOT ID no. 6106469
  misc_feature: Encodes the peptide sequence at SEQ ID NO. 2338
atgtctctccccccggacggcggcggtggcaccggcgacgactggttcctcgactgcggcatcctcgacgacctcccggccgcggcctgcggggccttcccgtgggacgcgtccccgtcgtcttccaaccccaggtccgcccacccgaattgaccgatcgattcctccctccccctccacgccccctttctagttccgaaaggcgcggatgctttgtttagcgtaggttcctggcgatcggttccttggccgctgcgttccgtatctctgcgattagtatcgtggaatctcgacgggcggatgaattatttttttgggatttgggggcgtctatctcgggtagtagatgcatgcgccgggaggcatctgatccggagaggtggttgctttatgctgcagatcttccggtctgttattctatttgtgctataaacttgccgaggctgcttttctattggttaaattagattagagttcccaaaagacaaaaatggttccctcaaaaaataaggctgctgagtttgcgtgctgcaagataacttgtcttggaagatttgttctcgtgtttccgcgactatgtttatgctgtgcaatggatggatcatatgtgatgatgaccagtgatttgcccaaacaattgagatggtctgctctagtgtacactgttttatgttggcgacttaattgatgggggattgtgttaccaatctgatgacgagtatgagtgcgagcgatggggtgtgatgctgggtcatggatggaatcgtaatacaccactgcagagccaaagatatagtttcctgtctgtcatgtatatgctgatgctgctacgatgttaatttgggagtaatttgcagtatcatgttgtttgacccctttttgctttactgaaagcagcctactccatatgggcagagttcaatgccttacatttagctagttttctgattattactttcatcgatgaatgatgttcggttatttggttgaaattaattaggtacttgcaaatggggaaaaaataagttcatgtacaattggaactgctaattgatcttccccttattttacagtgtggaagtgggcagctatgtgaacacaaatgatgtcttcaaggagcccaatgatgtcttcaaggagcctggcagcaataaacggtgtgtctgttatttcactctacggcttaaaagaagtattcatactgtcttgctgtatgcagccaccattgttacaattgtaactctattgcaacttgcagtttaaggtcaggatccaatgatgtgccaacatctaaagcttctagggaaaaaatgaggaggaacaaactgaatgataggtaaatcatagacataattttgctgacactgtagtatcaaagatggattgccatgtcattgacatacgtttcaattgtttcttgtggtttataggtttcttgaattggggtctacattagaaccagggaagccagtaaaagctgacaaagctgctatcctaagtgatgctactcgcatggttattcagcttcgttcagaagcacagcagctcaaggaaactaatggtagccttgaagaaaagattaaagaactaaaggttattcagctattttttgttaactcacatataatacattgtccttttatggtgagagcatgcctgtgttattcaggaatccataacatttcccagtagtactcttatgttcatctatatgagatctttatctaaggctggcaatgctttatggtagcttatggcctgtacatgaatacactgtgattgctcttgcaaagctcacccaagacatttcccagtagcttacaccaaatcagcccctggctgacaacagactacataactagttacctatatgttgattatccacaactgagcacaaagtgtgaattgatcatataaagacttctagacctgtcaatggggagggtatgaacacacccaggcttacccatgccacatttagcactacaggttgtgactgttatggaggggacgtgtgtttcctgtgatatctctgagaaacaactatgttggaaggacacaaggaaaggagaggagattacgggtagaaatggggaggcccgtaccttacccttgatcctaggggtagcaagctacttacccatacctgacccaaatcacatgggtgtgaatttgggggaacatgttagggtatccaatgacaggtctaaacccttcatttttttttatgatggatacaatttgctatcatacttttgaaatatctgtaattctgggaaattcacagtccatgataaccctttatatagagtccgagtttgttattaatttgatcagactgttgattatattatactgttcaatgtagctgctatggctcaactactctcaagtactcagctgtggaaaaatattcttgaggccacaaagttattttttttcctatgatcagactgttcttgtttctttaaattccaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaa

SEQ ID NO: 2338 - protein, 250 aa, Sorghum bicolor
  misc_feature: Ceres ANNOT ID no. 6106469
  misc_feature: Functional Homolog of  Ceres CLONE ID no. 16284 at SEQ ID NO. 526
  misc_feature (81)..(132): Pfam Name: HLH Pfam Description: Helix-loop-helix DNA-binding domain
MSLPPDGGGGTGDDWFLDCGILDDLPAAACGAFPWDASPSSSNPSVEVGSYVNTNDVFKEPNDVFKEPGSNKRLRSGSNDVPTSKASREKMRRNKLNDRFLELGSTLEPGKPVKADKAAILSDATRMVIQLRSEAQQLKETNGSLEEKIKELKAEKDELRDEKQKLKLEKESLEHQMKLMTSTPAYMPHPTLMPAPFPQAPLAPFHAQGQAAGQKLMMPFVSYPGYPMWQFMPPSEVDTSKDSEACPPVA

SEQ ID NO: 2339 - DNA, 1557 bp, Sorghum bicolor
  misc_feature: Ceres ANNOT ID no. 6108173
  misc_feature: Encodes the peptide sequence at SEQ ID NO. 2340
atggcgcagcggggcgagctggggcggcagctcccgctgagaggccccctgaaagccctagaggcagacatccaccacgctaacgccatgtaagcatctttacctctgaccccgccctggattgtgcgctattttgggcatttctcgcctcggttgcgccttggattagatttttcttataaccgtaatttgtgcgctgaaattggggaaagtgcccagtttggaaaaaaggccgtactttgtcgactcccagcgtagggtactaactttgtaaattcactccaattgatcaacgaatagagtaattcagggagttcacctgcggttatgctaggaattagggaaaaaaaacataatcggtatgttggccagccataatccattgcatttctgaagaatgctgctttggaataacaatttttctcccctatgtgtgtttcaatgctgctgtgatgattggttattaggttggacggtttcaacttactgctggtttgcaaattctagggcagatgcagttcagaggaattatggtggagcatgcgtgcagatgaggctgtcgttcagctccctggctccgttcttcttgtacttcatccaatggctggactgcggctgctgttatgctcttcccagctatttgggactgtttcatattctcatatgcaaggtaaaactgcagtatggagttttggaatttggacctcttatatttgtttttctgaacaggagacctgaatttcaagcattaaaatctttatacttcgttcatgcaggtttacgctgatggagatagctcggtgtcgacatatgaaaggcgggcaagcctgagggaattctatggtaatctctagcccacatgggcacttcgtaacctccacttcaatctgctttggactaattctcataagcttcttgcattgcagcaattatctatcctattctgcagcagcttgagagtagtttgattgagagggacctgaaagggaagggtcgatgcaaagatatagtgagtaggaggaggatggaggattggaaaaagatttctggtaaagaccttgaaagggaggacgaatgcgggatttgcatggaggcatgcaccaagatggtcctgcctaattgcagtcatgcaatgtgcataaagtgctatagagactggtaattacctttcataatttttatattctgtatgcaaatttgaacaggcttatgcaatttggattctgagtctaattatatcactacattttagttatttaataatacaatgtatgtccatgtgttgttataacttttgttgccttctattgatagctttgcttcatgttatattattgttggtataggtataaaagatcagagtcttgccctttctgccgaggaagcctcaaaagaatccgctcaagagacctttgggtgcttacaaattacaatgatgtcattgaccctgcacatttagaaagagaaaacgtgaggcatttctatagttatattgacagcttgcccctaatacttcctgatagtattttctttttctattatgattatctactataa

SEQ ID NO: 2340 - protein, 244 aa, Sorghum bicolor
  misc_feature: Ceres ANNOT ID no. 6108173
  misc_feature: Functional Homolog of  Ceres CLONE ID no. 156298 at SEQ ID NO. 490
  misc_feature (148)..(185): Pfam Name: zf-C3HC4 Pfam Description: Zinc finger, C3HC4 type (RING finger)
MAQRGELGRQLPLRGPLKALEADIHHRNYGGACVQMRLSFSSLAPFFLYFIQWLDCGCCYALPSYLGLFHILICKVYADGDSSVSTYERRASLREFYAIIYPILQQLESSLIERDLKGKGRCKDIVSRRRMEDWKKISGKDLEREDECGICMEACTKMVLPNCSHAMCIKCYRDWYKRSESCPFCRGSLKRIRSRDLWVLTNYNDVIDPAHLERENVRHFYSYIDSLPLILPDSIFFFYYDYLL

SEQ ID NO: 2341 - DNA, 409 bp, Sorghum bicolor
  misc_feature: Ceres ANNOT ID no. 6108946
  misc_feature: Encodes the peptide sequence at SEQ ID NO. 2342
atgtcttggagcgacagtgagaacgcggtgttcgagcgcgcgctggccacgtacgaccgggacacgcccaggcggtgggagctcgtggccgccgcggtgggcggcgggaagaccgccgaggacgcgaggcgccactacgcccacctcgtcaatgacgtcggcgacatcgagtccggcggctacggcaacgaccccaaccccaaccccaacgccgccgcccgcaacggcaacaacgggaacaacaacaggtgcgtgtcgatcacttatactcactttcgcgtgcatatatagctagtccgatcgaccacacacaccgatcgagacttcagtttatgaatgcctaatttacgtccacatgtggttcgatatatgatttcgcaggggcagagccaacaggccccagagatga

SEQ ID NO: 2342 - protein, 91 aa, Sorghum bicolor
  misc_feature: Ceres ANNOT ID no. 6108946
  misc_feature: Functional Homolog of  Ceres CLONE ID no. 143475 at SEQ ID NO. 1838
MSWSDSENAVFERALATYDRDTPRRWELVAAAVGGGKTAEDARRHYAHLVNDVGDIESGGYGNDPNPNPNAAARNGNNGNNNRGRANRPQR

SEQ ID NO: 2343 - DNA, 645 bp, Sorghum bicolor
  misc_feature: Ceres ANNOT ID no. 6111686
  misc_feature: Encodes the peptide sequence at SEQ ID NO. 2344
atgcggcgcggcggcggcgtggcggcggcggcggaggcggacggtgacgtggagtcacggttccgcggcgtgcggaagcggccgtggggccgctacgccgcggagatccgtgacccggcgaagaaggcccgcgtctggctcggcacattcgactccgccgaggacgccgctcgcgcctacgacgccgctgcgcggatgctgcgcgggcccaaggccaggaccaacttcccgctccccgccgcagccgcccaccaccaccttcacatgcccgccgccgccgccgcagcagcagcgccgtacacgacgtatcccaacgccacgggcgtctcgacgccgccggtcgctaggccggcttgcagcagcctaagctccaccgtggagtccttcggcggcgcgcggccgcggcccgtgctcccgccgcggcctcttccgccgccgatccccgacggcgactgccgcagcgactgcggctcctcggcctcggtcgtcgacgacgactgcacggacgcggcggcctctccgtcgtgcccggtcccgctcccgttcgacctcaaccttccccctggcggcggcggctgcggagccggcgtcgggttgtacgctgatgaggaggatgagctcaggctcacggcgctgcggctgtga

SEQ ID NO: 2344 - protein, 214 aa, Sorghum bicolor
  misc_feature: Ceres ANNOT ID no. 6111686
  misc_feature: Functional Homolog of  Ceres CLONE ID no. 124720 at SEQ ID NO. 1302
  misc_feature (19)..(70): Pfam Name: AP2 Pfam Description: AP2 domain
MRRGGGVAAAAEADGDVESRFRGVRKRPWGRYAAEIRDPAKKARVWLGTFDSAEDAARAYDAAARMLRGPKARTNFPLPAAAAHHHLHMPAAAAAAAAPYTTYPNATGVSTPPVARPACSSLSSTVESFGGARPRPVLPPRPLPPPIPDGDCRSDCGSSASVVDDDCTDAAASPSCPVPLPFDLNLPPGGGGCGAGVGLYADEEDELRLTALRL

SEQ ID NO: 2345 - DNA, 645 bp, Sorghum bicolor; identical to SEQ ID NO: 2343
  misc_feature: Ceres ANNOT ID no. 6111686
  misc_feature: Encodes the peptide sequence at SEQ ID NO. 2346

SEQ ID NO: 2346 - protein, 214 aa, Sorghum bicolor; identical to SEQ ID NO: 2344
  misc_feature: Ceres ANNOT ID no. 6111686
  misc_feature: Functional Homolog of  Ceres CLONE ID no. 560961 at SEQ ID NO. 1062
  misc_feature (19)..(70): Pfam Name: AP2 Pfam Description: AP2 domain

SEQ ID NO: 2347 - DNA, 1318 bp, Sorghum bicolor
  misc_feature: Ceres ANNOT ID no. 6112668
  misc_feature: Encodes the peptide sequence at SEQ ID NO. 2348
atggagcaggagctgcaccggcccatggagctgcccccgggcttccgcttccacccgacggacgaggagctcatcacgcactacctcgcccgcaaggtcgccgacgcccgcttcgccgcgctcgccgtcggcgaggctgacctcaacaagtgcgagccctgggacctgccatgtaagcaccggcacaacgcctgctgttatctctgcacgagtcgaatcatgcatggctaaaggaaatatgcatcgatcggcatggtggtttggttgcgcatgcagcgctggcgaagatgggggagaaggagtggtacttcttctgcctcaaggaccgcaagtacccgacggggctgaggacgaacagggccacggaggccgggtactggaaggccacgggcaaggacaaggatatcttcaggggcaacggcggcaaggtgctcgtcggctccaagaagacgctcgtcttctacacggggagggcgcccaagggcgagaagtccggctgggtcatgcacgagtaccgcctccacggcaagctccatggcgccatcgtcccccccaaggccgccgccggctccaaggttggttggttcttgaattgatttctaggagcatgcgcatgtgcgtacacaattctctctcgcatcgcaaccatcgatagatagatcatgtctcctaatttggaatgaattggaccctgttttctttctgtgggtgtgggcagaacgagtgggtgctgtgcagggtgttcaagaagagccttgtcgtaggcggtgcagcagcagcagcaccagccgcaggcaaaaggggcgccatggagatgtccaagatgaacgacgacatggcggccatctctcacctccctccgctgatggacgtgtccggcgccggcgccaacgtcaaccccgcggcggcggcacacgtgacctgcttctccgacgcactggagggccaccagttcttcaaccagcagcagacgccgccagaagccgacgccacggaccacctcggcctcgccgcctcctcgccgttcctgctgtccggcttcgcgcattacgggccgctgcaccacggcgcgacgagcctggtgcagctcctggagggcagcgtcgtgtacgctgccgccggcggtggcggcctcccggacatgtccaacaagcagcaacagcagcccgtgccggcgccgccgtgcaaggtgggcggcgagcgggagcggctgagcttgtcgcaggacacggggctcacctccgacgtgaaccccgagatctcctcctcctccggcgcccaacggttcgaccacgaccacctctgctggggctactga

SEQ ID NO: 2348 - protein, 356 aa, Sorghum bicolor
  misc_feature: Ceres ANNOT ID no. 6112668
  misc_feature: Functional Homolog of  Ceres CLONE ID no. 8334 at SEQ ID NO. 1104
  misc_feature (11)..(140): Pfam Name: NAM Pfam Description: No apical meristem (NAM) protein
MEQELHRPMELPPGFRFHPTDEELITHYLARKVADARFAALAVGEADLNKCEPWDLPSLAKMGEKEWYFFCLKDRKYPTGLRTNRATEAGYWKATGKDKDIFRGNGGKVLVGSKKTLVFYTGRAPKGEKSGWVMHEYRLHGKLHGAIVPPKAAAGSKNEWVLCRVFKKSLVVGGAAAAAPAAGKRGAMEMSKMNDDMAAISHLPPLMDVSGAGANVNPAAAAHVTCFSDALEGHQFFNQQQTPPEADATDHLGLAASSPFLLSGFAHYGPLHHGATSLVQLLEGSVVYAAAGGGGLPDMSNKQQQQPVPAPPCKVGGERERLSLSQDTGLTSDVNPEISSSSGAQRFDHDHLCWGY

SEQ ID NO: 2349 - DNA, 1683 bp, Arabidopsis thaliana
  misc_feature: Ceres CLONE ID no. 1204
  misc_feature: Encodes the peptide sequence at SEQ ID NO. 924
aatgattcacacaaactctctatataaagccattacttaataccacacaaattacaaaaaaaaaaaagaaaaaaggagataataatcacaaactacaaaagtagaaagaagaaaaaagaacaaagtatcagttcttgaatatttgcatcaatggaggaatccaaaacacctcacgttgcgatcataccaagtccgggaatgggtcatctcataccactcgtcgagtttgctaaacgactcgtccatcttcacggcctcaccgttaccttcgtcatcgccggcgaaggtccaccatcaaaagctcagagaaccgtcctcgactctctcccttcttcaatctcctccgtctttctccctcctgttgatctcaccgatctctcttcgtccactcgcatcgaatctcggatctccctcaccgtgactcgttcaaacccggagctccggaaagtcttcgactcgttcgtggagggaggtcgtttgccaacggcgctcgtcgtcgatctcttcggtacggacgctttcgacgtggccgtagaatttcacgtgccaccgtatattttctacccaacaacggccaacgtcttgtcgttttttctccatttgcctaaactagacgaaacggtgtcgtgtgagttcagggaattaaccgaaccgcttatgcttcctggatgtgtaccggttgccgggaaagatttccttgacccggcccaagaccggaaagacgatgcatacaaatggcttctccataacaccaagaggtacaaagaagccgaaggtattcttgtgaataccttctttgagctagagccaaatgctataaaggccttgcaagaaccgggtcttgataaaccaccggtttatccggttggaccgttggttaacattggtaagcaagaggctaagcaaaccgaagagtctgaatgtttaaagtggttggataaccagccgctcggttcggttttatatgtgtcctttggtagtggcggtaccctcacatgtgagcagctcaatgagcttgctcttggtcttgcagatagtgagcaacggtttctttgggtcatacgaagtcctagtgggatcgctaattcgtcgtattttgattcacatagccaaacagatccattgacatttttaccaccgggatttttagagcggactaaaaaaagaggttttgtgatccctttttgggctccacaagcccaagtcttggcgcatccatccacgggaggatttttaactcattgtggatggaattcgactctagagagtgtagtaagcggtattccacttatagcatggccattatacgcagaacagaagatgaatgcggttttgttgagtgaagatattcgtgcggcacttaggccgcgtgccggggacgatgggttagttagaagagaagaggtggctagagtggtaaaaggattgatggaaggtgaagaaggcaaaggagtgaggaacaagatgaaggagttgaaggaagcagcttgtagggtgttgaaggatgatgggacttcgacaaaagcacttagtcttgtggccttaaagtggaaagcccacaaaaaagagttagagcaaaatggcaaccactaaatatttgatgttctaatatgatttgtataatcaacggtgggatttgtgcaaatgtgtttctgtatgtatatgtatgttctacttttcttt

SEQ ID NO: 2350 - DNA, 753 bp, Arabidopsis thaliana
  misc_feature: Ceres CLONE ID no. 1349
  misc_feature: Encodes the peptide sequence at SEQ ID NO. 2046
atctgtgtctcaaaagacaagtagattccttttttttacagtatccaataatttgtaatcatataaataatcggtgaaaaagaaggattctttgtttgtttcccgagaaaatatcctcgatttccatctcctatctgtcatcggagctttctacttccgaaggaataaaggatcaatcaagagtttgatcttgttagaatagccgataatggaaggagatgtgttgtcaggatttggagacagacacaatatggatgggaaattgttgcagagtttccagaagagctttgtggatgttcaagacattttggaccaaaaccgattattgatcaacgagatcaatcagaaccatgaatcgaaacaaccagataacttgggtcgaaacgtggggttgatcaaagagctcaacaacaatatcagaagagtagctagcctttatggtgatctctctcattcttttgcaagatcagtggatgcttcatcagaaggtgaatctagtggaactttgaaatctgatgggaaagctaaccagaagagatttagatccggttagtattgtaaccaagaggtccaagaccatcaaagttgattatcatagattcatattcagattcagagctaattgattgaggagaaaggagaaaggagagttttacaaatgtaatatctctattgaaatgattaagagagtctttacaagaaacttgttgtaaagtttacacatttcggtttaaggattcttctgtttttctt

SEQ ID NO: 2351 - DNA, 957 bp, Arabidopsis thaliana
  misc_feature: Ceres CLONE ID no. 1911
  misc_feature: Encodes the peptide sequence at SEQ ID NO. 1951
aaaagtcaaaaaagggtaaagcagcaaaaccctaataaaatcacaacaaattaacacaaaaaaccagatcttaaaactctctctacccaccaagaggatcaaccagtctcttcccttcagattctcctttccacagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcttttaggcctaccttgtagtcttggggttttgtttctgttttcgaataatggtaacctttgtataacttatttcagtatcgtctcagtttggtact

SEQ ID NO: 2352 - DNA, 1101 bp, Arabidopsis thaliana
  misc_feature: Ceres CLONE ID no. 3115
  misc_feature: Encodes the peptide sequence at SEQ ID NO. 1045
aacttgttttcttcagcgagcgacattttggaaggaagcattccattagcttttttgctgtctccagaaaataaattttcaatctttcgtcggaaaaaagaagaagaagaagcagagctgggtttagttttttcacgagaagcaaagagatcaataagtcagtgagcttttttctcgtttctgacgatggcggttgcgccggcaagagctcgttcagactatgattacctcatcaagcttcttctcatcggcgatagcggtgtggggaagagttgtttgttacttcgattctcagatgatactttcactacaagtttcattactaccattggtattgacttcaagataagaactgttgaacttgatgggaagcgtatcaaattgcagatttgggacactgctggtcaagaacgtttcagaactatcactacagcgtattacaggggagcgatgggtatattgcttgtctacgatgtaacggatgagtcatcttttaacaatattaggaactggatgaagaacattgagcaacatgcctcagataatttcaacaaaatattggttggtaacaaagctgatatggatgaaagcaaaagggctgttccaacagcaaagggccaagctttggctgatgagtatggaatcaaattctttgagacgagtgcaaaaacaaacctcaatgtcgaaaatgttttcatgtcaatcgcaaaagacataaaacaaagattgacagaaaccgacacgaaggcagagccccaaggcatcaagatcactaaacaagatactgccgcatcgtcttctacagccgagaagtcagcttgctgtagttacgtttaggattatgattgctctttttcgcctgcaccgggttttttaaatatctggccatctttttcatctcttacgtctcaaatcagagataattctcatgttgttacctagaacgagtaggaaatctcattgatggttgtgatctttatgtctaatttgttatctccataattcctgtacaatgatcttcctgatatggaagactatgttggtcaaaaaactatgtgaaaaagactttgaatttataaaaatgaaactgttgtagtgtgt

SEQ ID NO: 2353 - DNA, 788 bp, Arabidopsis thaliana
  misc_feature: Ceres CLONE ID no. 4267
  misc_feature: Encodes the peptide sequence at SEQ ID NO. 1633
  misc_feature: Encodes the peptide sequence at SEQ ID NO. 1634
  misc_feature: Encodes the peptide sequence at SEQ ID NO. 1972
aacaacacttagagaacaagcagaggaatataactttttttttctttttcctttttgcttttttacaaccaaaaaaataaagcaagccgtagagagcaagagacggtgtaaagatgcactacacacgcatctcgccggctttagtaccatctctatcaccaaccgccgcggctgaatctagcgatggtgggacgatgatagctactgttttcatggcccttctcctcccctgcgtcggcatgtgcatcgtcttcctaatctatctattcctcttgtggtgctccacacggcgtcgtatcgaacgccttcgatttgctgaaccggttaaaccggtcgcaggtaaaggcctttcggtgttggagctcgagaaaatccctaaactcaccggaagagagctagccgtaatagctagatcaacggaatgtgctgtttgccttgaagatatagagagtggtcaatcgactcgtctagttcccggttgcaaccatgggtttcaccaattatgtgctgatacgtggctatctaaccacacggtttgtccagtttgccgcgccgagctggctccgaacctacctcaatgtaatgaaaatcaaagtccatgttagaaacagaattttcaaaaacattctttccttcttttttactcgttttgtgtacttctcttgtttttcccttttcttagttttgtgtaagcgttatagagagagaagtttccaggttgtaactagccttgttgtttttttttgtacatgaaattagttttagagtaaattacgaaatttacagcc

SEQ ID NO: 2354 - DNA, 652 bp, Arabidopsis thaliana
  misc_feature: Ceres CLONE ID no. 8364
  misc_feature: Encodes the peptide sequence at SEQ ID NO. 1944
aaaaagcccctaattttttctccgcccaagagacaaaaatccttcgcaatcgagcaacggaagctcctgcatccaccgtccaaatctcttctaacgtcgccggagatcgatcgttggggaagtagagaatggcgacgtttgagctgtacaggagatcgacgatcgggatgtgtctgacggagactttggacgagatggttcagagcggtacgctgagccctgagctagctatccaagtccttgttcaatttgacaagtccatgactgaagctctggagagccaagtgaagaccaaggtgtccatcaagggacacctgcacacttacaggttctgtgacaatgtctggaccttcatattacaggacgcaatgttcaagagtgacgatcgtcaagagaatgtgagccgggtgaagatagtggcatgtgattccaagctgctcacacagtgagatgcaaattgtctgcagggaatttactttcctttgtactagattttgagttttttcactttgtaaactcagcacttgctatatatgttgagcacttgctatatgttgagctccatctgcagccatcaatttagcctatatgtaaattctcggcccaaggacataaggatacattctgttgctataagaaagttcttgagctc

SEQ ID NO: 2355 - DNA, 1086 bp, Arabidopsis thaliana
  misc_feature: Ceres CLONE ID no. 9763
  misc_feature: Encodes the peptide sequence at SEQ ID NO. 1168
atcaaactttgttttctttgcttcttctatcttcttcttctttcttcttctcgctttaatactctttgattcctctgttcgtttgatgagaattagattttaaatggcaaaagtttcgtttaaggattctctgaaagctcttgaagctgatattcaacacgctaacactgtagctttagattatcctcgggagaaggatggagcgcgtgttcaaatgaggctatcgtacactccagctgctcagtttttactttttcttgtacaatggactgattgccatcttgctggtacactcggtctgctcagagttctgatttacatgacctatgcggatgggaaaaccacaatgtcggtttatgagagaaaaacaagtattaaagatttctatgctgtgatatttccgtcgttgttacaactagaaagaggtatcacagacctggatgatcgtaaacagaaagaggtctgcaaaatacggtacagaaataaagatgagagtgaaaaggtcaagctctcggagattgacatcgagagagaagaagaatgcgggatttgtatggagatgaacaacatggtggttctccctaattgtacgcattctttatgcatcaagtgttaccgcgattggcacgggaggtcagaatcatgccctttttgccgagacagtcttaagagagtaaactcaggggacttatggatgttaatggagaaatccgatacggttaatatgtatacaattgagcgggagaataagaagaggttgtttgtgtatatagagaagctacctctagtggttccagatcaagtgtttgcgtcttctccttatgattgccatgtcaagtaaataagacggagaagagctttggcaaaagccgaaaccgggtctggtaaacttttatctgaatgtatgtatataatgtttagagtagtagtaagtaatatagtgtaactatttcttggggaagtccatttctacttgcttttctttttatctgcatttggcttttggttcccaaaaactcttatttcagttgtacattcatgtctgaatttaaaaacgtcttcttcaagaaatggctttcactcacc

SEQ ID NO: 2356 - DNA, 911 bp, Arabidopsis thaliana
  misc_feature: Ceres CLONE ID no. 10506
  misc_feature: Encodes the peptide sequence at SEQ ID NO. 1047
aagaaagaggatacagaatagtgattactaacatcttctccgatggcggttgcgccggcaagagctcgttcagactatgattatctcatcaagcttctcctcatcggtgatagcggtgtgggaaaaagttgcttgttactgcgtttttcggatgatactttcaccacgagtttcattactaccattggaatcgacttcaagataagaacagtcgaacttgatgggaagcgtatcaaattgcagatatgggacactgctggacaagaacgttttagaactataaccacagcatattacagaggagcgatgggtatattactcgtctatgatgtaacagatgagtcatcattcaacaacattaggaactggatgaaaaacattgagcagcatgcgtccgatagtgtcaacaagatattggtcggtaacaaagccgacatggacgaaagcaaaagggctgtcccaacatcaaaaggacaagctcttgctgatgagtatggaatcaaattctttgagacgagtgcaaaaacaaaccagaatgtcgagcaggttttcctttctatcgctaaagacataaaacaaagactcacagaaagcgatacamaagccgagccccaagggatcaagatcactaaacaagatgctaacaaagcctcatcgtcttctacaaatgagaaatcagcttgctgcagttatgtttagaagttctctgaacctgtttctaatctcttaccgtctttaatcttcttcgcatcattcaagggatcgtcctatgttcttattagtaggaggatagacttaattgatagctgtgtgtattttgctatctcgatggccaaacactgtactggtaatggtagacaatgtttaagtgcttaaactttgaattaatgaaatgcagatgttatgtgtgc

SEQ ID NO: 2357 - DNA, 1517 bp, Arabidopsis thaliana
  misc_feature: Ceres CLONE ID no. 11226
  misc_feature: Encodes the peptide sequence at SEQ ID NO. 757
atcattctatcctaaatcctcatcactcaacctgagctcacaaagctaaacaaaaaaaaaagagcttaggcggagaagaagaggagaccaaaacaccaaacaaacaacaatggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaaaacaaacgaagcgaagccaaatagaacgcgtcgataaatacatccgcagtttcttctttttcttatttctttctttctttatgcgttgtttaccgcggattttcatggcgaaaaggacggtcttgcttgtttgtaatttgtgtggagataaaaagaaaaagcctgtaatgtagagaagtgaatagcagagcaataacagttcagtttatagaacgccttc

SEQ ID NO: 2358 - DNA, 572 bp, Arabidopsis thaliana
  misc_feature: Ceres CLONE ID no. 12459
  misc_feature: Encodes the peptide sequence at SEQ ID NO. 1196
  misc_feature: Encodes the peptide sequence at SEQ ID NO. 1203
aaactcatcacttacttaacatactaagagagttattagatcttgaaaaacatggcttccaaggctttgattctgttgggtctcttcgcaattcttctggtggtctccgaagtttctgccgcaaggcabtcgggcatggtgaagccagagagtgaggaaactgtgcaacctgaaggttatcacggaggacatggtggtcacggagggggaggccactacggaggaggaggccacgggcatggaggacacaacggaggagggggccacggacttgacggatacggaggaggacatggaggacactacggaggaggaggaggacactacggaggaggaggaggccacggtggtggtggacactatggaggtggaggacaccatggaggaggaggtcacgggctgaacgaacctgttcagacgaagccgggtgtttaaaagttataactatcaaataaattcaccatgcataattgcatctctatatacacttatgtcttatatgtatccatcaaaataaaccatggtgagtttgtaatgcagttccttcagaaatgtgtggaataatgtttcac

SEQ ID NO: 2359 - DNA, 726 bp, Arabidopsis thaliana
  misc_feature: Ceres CLONE ID no. 13439
  misc_feature: Encodes the peptide sequence at SEQ ID NO. 242
aacataagtctctctcttacattttgaaaccctaatttctcaaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggcggcggtggtggcsgctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttacc

SEQ ID NO: 2360 - DNA, 668 bp, Arabidopsis thaliana
  misc_feature: Ceres CLONE ID no. 14187
  misc_feature: Encodes the peptide sequence at SEQ ID NO. 241
cataagtctctctcttacattttgaaaccctaatttctcaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggcggcggtggtggcggctggtaatcaaagatagagttgtttgcgtgctgctgctctgtttttggtttagatttggatttgtgtcaccacttctggtttggttatcgttcgtttggtttacttttttgatgaaacag

SEQ ID NO: 2361 - DNA, 692 bp, Arabidopsis thaliana
  misc_feature: Ceres CLONE ID no. 18200
  misc_feature: Encodes the peptide sequence at SEQ ID NO. 1813
aacaccttcttctccactctcattctctctttctgacacattaactacttatccttcttgcattcttctctctctctacacccaaacaaacacacttataatatatcaagaaagaagatgtctagcagaagatcatcacgttcaagacagtcaggaagctcaagaatctctgacgatcagatttccgatcttgtttctaagctccaacacctcatccctgaacttcgccgccgccgttctgacaaggtgtcagcatctaaggtactacaagagacttgcaactacatcaggaacttacacagagaggttgatgacctcagtgaccgtttgtcggaactcttggcttcgacggacgacaacagcgccgaaacagccatcattaggagcttgcttaattattaaatccgcattacttaatctgagagctattaatcatccgtttccggccaccaaatttatcttattatgggtatcgtctgtttacttctacatcatatattatgagatatagctagggtttcgggtcattgttaggccaactcatatatttatatttaatatatggttatgtatgtatgtatgcatgttaattgtatctgagggtccagacctggcgtatagtagcctgtgtatcatgagatcctctaatatttatgattaatgacacggtccgtttccttttttactatacc

SEQ ID NO: 2362 - DNA, 509 bp, Arabidopsis thaliana
  misc_feature: Ceres CLONE ID no. 18215
  misc_feature: Encodes the peptide sequence at SEQ ID NO. 1188
aactcatcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgt

SEQ ID NO: 2363 - DNA, 568 bp, Arabidopsis thaliana
  misc_feature: Ceres CLONE ID no. 19640
  misc_feature: Encodes the peptide sequence at SEQ ID NO. 2049
attttcccgagattattttcttgatttcctcctctgcttcctcttcccggagcttgttttttcaaagaatcaagatttgagatttgatggaatcaagaatggaaggagatgtgtattctggatttggagagagataccaaatggatggtaagttgttgcagaatttccagaagagctttgttcaagttcaagacattcttgatcagaaccggcttttgatcaacgagatcaatcagaaccatgagtcgaaacaagctgatcacttgggaagaaatgttggtttgataagagagctcaataacaatatcagaactgttgcaagtctttatggagatctctctcattcttttgctagatcggttgatgcttcatcggaaggcgaatctaccgggacattgaaatctgacggtaaggccaacaaccagaagagatttagatccgggtaatataaccaaaaacatcttgattttgtagattcaaagctaatttgattgtggattaaggtgtgtcatgtttttgttgttgttgttgtggaacagttatgacattaatattgtgttttcttcct

SEQ ID NO: 2364 - DNA, 509 bp, Arabidopsis thaliana
  misc_feature: Ceres CLONE ID no. 23214
  misc_feature: Encodes the peptide sequence at SEQ ID NO. 1191
atcacttacttaacatactaagagagttattagaacttgcaaaaaatggcttccaaggctttgattctgttaggtctcttctcagttcttctcgtcgtctccgaagtgtctgccgcaaggmawtcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgc

SEQ ID NO: 2365 - DNA, 942 bp, Arabidopsis thaliana
  misc_feature: Ceres CLONE ID no. 24161
  misc_feature: Encodes the peptide sequence at SEQ ID NO. 121
agagctcaagagaagtaaagaaactgcgacaagagaaagaagattgactttggagaagagaggagtaacgatggaagatattcataatctcgatatagagaaaagtgatagatcgatttggttgatgaagtgtcctgtagttgtagacaaggcatggcacaagatagcagcttcgtcttcttcttcttttgcttcctcggattctcctcccgacatggcaaagattgttcgcgaagttgatcctctacgggacgattctccccccgagttcaaaatgtatatggttggtgctgagtatgggaacatgccaaagtgctacgctttgaacatgttcactgactttgttccgatggggggcttttccgatgttaatcaaggttgtgcagctgctgaaggaaaggttgatcacaaattcgatatgaagccatatggtgaaaccattgaagaatatgctaggctttgtcgtgagagaacgagcaaagccatggttaaaaatcgacagattcaggttattgataatgaccgcggagttcatatgaggcccatgcctggaatgcttggtttagtttcctccaattccaaggaaaagaggaaacctcccccagtcaagcaaaccgaggtgaagaggacgaggagagatcgtggtgagcttgaagctataatgttcaagctatttgaaggccagcctaactggacattgaagcagcttgtacaagagacggaccagccagctcagttcctgaaagaaatactaaacgagctgtgcgtgtacaataagagaggatcgaaccaagggacatatgagcttaaacctgaatacaagaaatctgctgaagatgatacaggtgggcagtgaaatcaaccccttgtgtaattcactattatatacatgtgacatagtcataacattattataaaccctgagtcattattcatcagaag

SEQ ID NO: 2366 - DNA, 517 bp, Arabidopsis thaliana
  misc_feature: Ceres CLONE ID no. 24667
  misc_feature: Encodes the peptide sequence at SEQ ID NO. 1193
actcatcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacactatggaggaggtggaggacactacggaggaggtggaggacactacggaggaggtggtggaggacacggaggtggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgc

SEQ ID NO: 2367 - DNA, 1161 bp, Arabidopsis thaliana
  misc_feature: Ceres CLONE ID no. 29982
  misc_feature: Encodes the peptide sequence at SEQ ID NO. 616
aaaaaaggataagcttggtgttactttatcgccttctttcgtttggcctttgatcctatcataagctttttttcgtttatcaatcttctcgattcagccacaattcttgtttctcagataattcatctcctttctttgattcgtttccttctcttctgtcactcagatctagatctagatctaggtttttttctttctcatcggaaatttgacttagaggcttgttttgatctagggtttggtctttgggaattttgaaaaaaaaaacaaaattaggaatgaatctatgagctactcaatcctgtttcgtcggattcgtattctacactctttctccgtcgtttacctctactacacctacgttttctcatgaagtaatcgttctcgatctcagttttcgtttttgatctaacttattctttgatagatttagaaatcggggattttcagattgtgtctttgagaggtttttataggaaaatatctctagaagaagaagaagaatattatattgattttaattttggtgagaagaagtcaaaaagtcaacgagaaatggggtcgttgcaaatgcaaacaagtcctgaatccgataatgatccgaggtacgccacggtgacggatgagaggaagaggaagagaatgatctctaacagagaatctgctcggaggtcaaggatgaggaaacagaagcaacttggtgatttgatcaacgaagtcactcttctcaagaatgataacgctaaaatcaccgaacaggttgatgaagcttcaaagaaatacattgaaatggagtctaagaacaatgtcttgagggcacaggcttcggagttgacggataggttaagatcattgaactctgtgcttgagatggttgaagagattagtggtcaggctttggatattcctgagattcctgaatctatgcagaacccttggcagatgccttgtccaatgcaaccaatcagagcttctgctgacatgtttgattgctgaagatggatgattcatatctgaaggatcaaaaatgaagcattgagatcgagtctttggtctgttttacttactgtccttgttgtaacaattagtgtgtcattggtgaattgagtcttgtgttgtcaatggacaacgcaatctttatgcaatttcaatttgttcgtg

SEQ ID NO: 2368 - DNA, 311 bp, Arabidopsis thaliana
  misc_feature: Ceres CLONE ID no. 30700
  misc_feature: Encodes the peptide sequence at SEQ ID NO. 2068
tgatattcagaaattctacaatgtggttgtcgaagagctgccttcgaacgtggccgatctgctgtgaagggagaaaagaagtcggttctgttgctgtgtttgctctgccgtactagtatcaccggagaagaaaggttttcttgttttgcaaggcactctttgatctgattttgacccgtcgtctatcagcgatttacatttcttaaattttcttagttgttgttctctcctctctctcccagctacgaacatatctctctcttcttgaccatttttaagtttaagtcatatggagtatttatttcttcacc

SEQ ID NO: 2369 - DNA, 756 bp, Arabidopsis thaliana
  misc_feature: Ceres CLONE ID no. 32548
  misc_feature: Encodes the peptide sequence at SEQ ID NO. 243
aaaatcacataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgasgatacggtggtggtggacgccgtgagggaggtggctacggaggcggtgatggtggaagttacggaggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaacc

SEQ ID NO: 2370 - DNA, 911 bp, Arabidopsis thaliana
  misc_feature: Ceres CLONE ID no. 33126
  misc_feature: Encodes the peptide sequence at SEQ ID NO. 1987
gcgtcatcgcgtttctcttaagcttctctcacatttctctttcaaatttcttcgagtctctctcgctctctccgtttcttcgcggtctctctctctcagatctctccgaaacattcttcgtagtgaagcaaaatggggttgagtttcgccaagctgtttagcaggctttttgccaagaaggagatgcgaattctgatggttggtcttgatgctgctggtaagaccacaatcttgtacaagctcaagctcggagagattgtcaccaccatccctactattggtttcaatgtggaaactgtggaatacaagaacattagtttcaccgtgtgggatgtcgggggtcaggacaagatccgtcccttgtggagacactacttccagaacactcaaggtctaatctttgttgttgatagcaatgacagagacagagttgttgaggctcgagatgaactccacaggatgctgaatgaggacgagctgcgtgatgctgtgttgcttgtgtttgccaacaagcaagatcttccaaatgctatgaacgctgctgaaatcacagataagcttggccttcactccctccgtcagcgtcattggtatatccagagcacatgtgccacttcaggtgaagggctttatgaaggtctggactggctctccaacaacatcgctggcaaggcatgatgagggagaaattgcgttgcatcgagatgattctgtctgctgtgttgggatctctctctgtcttgatgcaagagagattataaatattatctgaacctttttgcttttttgggtatgtgaatgtttcttattgtgcaagtagatggtcttgtacctaaaaatttactagaagaacccttttaaatagctttcgtgtattgtgcctggattaatatgattgattgttttgcttt

SEQ ID NO: 2371 - DNA, 1084 bp, Arabidopsis thaliana
  misc_feature: Ceres CLONE ID no. 36337
  misc_feature: Encodes the peptide sequence at SEQ ID NO. 364
aaaaaggacttgaaatattgaaatccctattctttacgcgtactcgagatttttcgctcttgagagaatcacttcgacaatgtcggtaacggctgctttcattgattcggatcaaactcagcacaacattcttatggattcccaatcaactgtctccggtgtgaaaactgtcaagattagcaatgtttcactaattgtttctaagaaagatgtcaaagagttcttttctttctctggtgacattcaatacgtcgagatgcgaagtgagacacaagagagtcaggtcgcatatgttacttttaaggattcacaaggagctgaaactgcaatgctcttaacgggagctgtcattgcagatcttcgtgttagtataactcctgctgttaactatcagctaccaccagaagcccttgcacttgactcggaacattcgtttaatggtttttctgtcaagaaagctgaagatgtggtgaacatcatggtgggaagaggttatgctcttggaaaagacgccatggagaaagccaaagcatttgatgacagacacaacttgatctcaaacgcttctgcaaccattgcatcgcttgacgataagatgggtctgagcgaaaagctaagcataggaacaactgtggttaatgagaagttgagagatatcgatgagcgatatcaggtgagggagataacgaaatctgctttagcagctgctgaagagacagcaatcagtgcaagaacggctttaatggcaaacccttatgtatcaagtggagcttcgtggttttcaaacgcgtttggcgcagtgacaaaggcggttaaagagaaagttgagaatggaggagaaggaagaaaggagatcatcacacttgatccctcttcacccaaagttcctgctgtagttcctgttaagctcggttgatgcagatctcatcaaaccaatcggatctcgactaaattctttgataggtttgttgttcatatatatgctttcgtatgctaaagaaaagataaaaagacataaaccatgaaaggtgttgttacattcaaccagcatttgttcctctcttgaaagagattattaagattc

SEQ ID NO: 2372 - DNA, 1467 bp, Arabidopsis thaliana
  misc_feature: Ceres CLONE ID no. 38780
  misc_feature: Encodes the peptide sequence at SEQ ID NO. 363
agttaattattggtgcgtctctcgaattagggttctaggatctctgctcttaaaactcttatcgccgctaaaactctctacccatcgcagagcctctctaaagaatggattctcagatcaagcacgctgttgtagtgaaagtgatgggaaggactggatcaaggggtcaagtgactcaggttagagtgaagttcactgactcggaccgttacatcatgaggaacgttaaaggacctgtcagagagggagatattctcaccttgctggagtccgagagagaagctagaagacttcgttgattctctttgcaaattgtttttggttgctttgaagaacaaatgttatatcgtttggataattaaattcttattatgatgttaaaaaatttaattatcaaagattgatgctttagactctaaatctatattatattaaaaaaaaaaaaaaaaaaaaaaaggacttgaaatattgaaatccctattctttacgcgtactcgagatttttcgctcttgagagaatcacttcgacaatgtcggtaacggctgctttcattgattcggatcaaactcagcacaacattcttatggattcccaatcaactgtctccggtgtgaaaactgtcaagattagcaatgtttcactaattgtttctaagaaagatgtcaaagagttcttttctttctctggtgacattcaatacgtcgagatgcgaagtgagacacaagagagtcaggtcgcatatgttacttttaaggattcacaaggagctgaaactgcaatgctcttaacgggagctgtcattgcagatcttcgtgttagtataactcctgctgttaactatcagctaccaccagaagcccttgcacttgactcggaacattcgtttaatggtttttctgtcaagaaagctgaagatgtggtgaacatcatggtgggaagaggttatgctcttggaaaagacgccatggagaaagccaaagcatttgatgacagacacaacttgatctcaaacgcttctgcaaccattgcatcgcttgacgataagatgggtctgagcgaaaagctaagcataggaacaactgtggttaatgagaagttgagagatatcgatgagcgatatcaggtgagggagataacgaaatctgctttagcagctgctgaagagacagcaatcagtgcaagaacggctttaatggcaaacccttatgtatcaagtggagcttcgtggttttcaaacgcgtttggcgcagtgacaaaggcggttaaagagaaagttgagaatggaggagaaggaagaaaggagatcatcacacttgatccctcttcacccaaagttcctgctgtagttcctgttaagctcggttgatgcagatctcatcaaaccaatcggatctcgactaaattctttgataggtttgttgttcatatatatgctttcgtatgctaaagaaaagataaaaagacat

SEQ ID NO: 2373 - DNA, 876 bp, Arabidopsis thaliana
  misc_feature: Ceres CLONE ID no. 98140
  misc_feature: Encodes the peptide sequence at SEQ ID NO. 1445
  misc_feature: Encodes the peptide sequence at SEQ ID NO. 1446
aggcctcatctcttactctctctctctgatcgtctttttcttttgattctgcttttttctgctaggtttctgagatcttccattcgtctcgaattaagttgctacgatgaagacagcgaaggggaaagataaagttaagaccacaaaggaagccttgaagccagttgatgacagaaaggtgggaaagaggaaggcaccggccgagaagcctactaaacgagagactcgtaaagaaaagaaggctaaaaaggacccaaacaaaccaaaaagagctcctagtgccttctttgtctttctagaagattttagggtcacgttcaagaaagaaaatccaaatgtgaaggccgtctctgctgttgggaaagctggagggcagaaatggaaggcaatgtctcaagctgaaaaagctccatatgaagagaaagctgcaaaaaggaaagctgaatatgagaagcaaatggatgcatacaacaaaaacttggaggaagggagtgatgaatctgaaaagtctagatctgagataaatgatgaagatgaagccagtggggaggaagaactactagagaaggaagcggcaggtgatgatgaagaagaagaagaggaagaagatgacgataatgatgacgacgaggaagaagactaaatcagggatagaaatcagattttgtatctcaagcttaactgcagatccttaagcagaagtaagtattttgtaatttgtgtgtcgacgagaactatagatctaaaatcgtgtgtatttttgtttttcttttcctaagaaagcgaaacagttgttagcatctctcaggatgtctgtttcagctttttgccgcaacaaacaatgtatcaatgtctgcgttagtgatcatccaaacc

SEQ ID NO: 2374 - DNA, 485 bp, Arabidopsis thaliana
  misc_feature: Ceres CLONE ID no. 102331
  misc_feature: Encodes the peptide sequence at SEQ ID NO. 239
acataagtctctctcttacattttgaaaccctaatttctcaaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggatactcaggaggaggcggtggtggttacgagagacgtagcggaggttacggatctggtggaggcggtggtggcgctggtaatcaaagatagagt

SEQ ID NO: 2375 - DNA, 575 bp, Arabidopsis thaliana
  misc_feature: Ceres CLONE ID no. 105261
  misc_feature: Encodes the peptide sequence at SEQ ID NO. 1190
atcacttacttaacatactaagagagttattagaacttgcaaaaaatggcttccaaggctttgattctgttaggtctcttctcagttcttctcgtcgtctccgaagtgtcttccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatattagtac

SEQ ID NO: 2376 - DNA, 1103 bp, Arabidopsis thaliana; identical to SEQ ID NO: 1376
  misc_feature: Ceres CLONE ID no. 108509
  misc_feature: Encodes the peptide sequence at SEQ ID NO. 1947

SEQ ID NO: 2377 - DNA, 538 bp, Arabidopsis thaliana
  misc_feature: Ceres CLONE ID no. 109026
  misc_feature: Encodes the peptide sequence at SEQ ID NO. 1199
  misc_feature: Encodes the peptide sequence at SEQ ID NO. 1206
atcacttacttaacatactaagagagttattagatcttgaaaaacatggcttccaaggctttgattctgttgggtctcttcgcaattcttctggtggtctccgaagtttctgccgcaaggcatkcgggcatggtgaagccagagagtgaggaaactgtgcaacctgaaggttatcacggaggacatggtggtcacggagggggaggccactacggaggaggaggccacgggcatggaggacacaacggaggagggggccacggacttgacggatacggaggaggacatggaggacactacggaggaggaggaggacactacggaggaggaggaggccacggtggtggtggacactatggaggtggaggacaccatggaggaggaggtcacgggctgaacgaacctgttcagacgaagggtgaggaacaagaggcagggaagaaggatttcattcagatactcaagactcttgaatctgagcttggagacaaaccttactttagtggcgatgactttggctatgtagacattaagggac

SEQ ID NO: 2378 - DNA, 1358 bp, Arabidopsis thaliana
  misc_feature: Ceres CLONE ID no. 114858
  misc_feature: Encodes the peptide sequence at SEQ ID NO. 1106
ctaacttctctgttcatctttttctctctttatttataaatttatctgcatagtactctctgaatctatatcttcaaaaaaaaaaaacgtccaagatcaaatcaagaaacccattaaaaaaaaaaatcaggttttggtttcagttttaagggtttaaggtttcttggggaagaaacgatggagactttttgtgggtttcaaaaggaggaagagcagatggatttacctcctgggttcaggtttcatccaacagatgaagaactcataactcactatctccataagaaggttcttgacaccagcttctcagctaaagctatcggtgaagttgatttaaacaaatcagagccatgggagttaccatggatggcaaaaatgggtgagaaagaatggtattttttctgtgtgagagacagaaagtatcccaccggtttaagaactaaccgagcaactgaagccggttattggaaggcgaccgggaaggataaagagatataccgaggcaaatcacttgttgggatgaagaagacacttgttttctatagaggaagagctcctaaaggtcagaaaaccaactgggtgatgcatgagtacaggcttgaaaaaaattctctgcccataacttgccgaaaaccgcaaagaatgaatgggtgatatgcagggtgttccaaaagagtgctggagggaagaagatcccgatttcgagtctaatccgaatcggttcactcggaaccgactttaacccttcgcttttgccctctttaaccgattcttcgccttacaacgataaaaccaaaacagaaccggtctacgtgccctgcttctccaaccaaacggatcaaaaccaaggaaccacactcaattgcttcagcagccctgttcttaactcgatccaagccgacatttttcacaggattccactctatcaaactcagtccctccaggtttctatgaatctacagagcccggttctcacgcaagaacactcagttctacatgctatgatcgagaacaacagaagacaaagtctcaaaacgatgagtgtctcacaagaaaccggagtttcaactgacatgaacactgatatctcatcggattttgaatttggtaagaggcggtttgattctcaagaagatccgtcttcctctactggaccggttgatcttgaacctttctggaattactgaagatgattcaagattctcatgtccattaatttactgtggtgtgttaaagtttgtataggctattgtcatatactctcatatcaacttccactatatattataacaatttaaagaaacttaaaaatatgatttgatatatgactaaagtattataatacaattttgtacccc

SEQ ID NO: 2379 - DNA, 932 bp, Arabidopsis thaliana
  misc_feature: Ceres CLONE ID no. 116606
  misc_feature: Encodes the peptide sequence at SEQ ID NO. 731
actactctctccactaaacaaaaacactagagttaagttacatatagagtaaggaagagatggcagttaggtgtttagccgtgttcctcgttgctctcatggtgtctcaagcagtcaccgcaacaagaccggctccaaccaagaatgtcggagctggtcttgacgaccaaaagaactttgtagcgttcgctggtgtcggtggagctgctggaattggtggagccggtggtgttggagctggtcttggtggtgtcgccggtggagttggtggtgttgccggagttttgcctgttggcggtgtaggcggcggaattggtggtctaggcggtggtgtaggtggtcttggcggtctaggtggtctaggtggtggttcaggtcttggtcatggagtaggtggaattggtggtaaccctggtattggtagtggtatcggtggactcggcggtgcaggtggtctaggcggtataggcggtgttggtggttttgatactcgaactggtgactggtcggagaccggtggagtatggtgaagacagctttgtgatacttagtgaccatgttcgagttatgttagaacaagggaatgtgttggagtgtattgatccagtgatggaggaacaatactctgaagatgaggttttgcctgtcttgaaacttgctctggtctgtacttctcagataccttcgaatcggccaacaatggccgagattgttcagatcttgcaggtcatcaattctcctgttccccaccgaatcatggatagtttctaaacatctttgtgttatagttaatttttcattagcttttctttttgcaaatgttactttgtctgtgtcctttgttgtggtctttgtgtagagattgcttatttcacaatgctacgctttctattccttcgttatcattatcgtaacgatcattgaccattgcc

SEQ ID NO: 2380 - DNA, 1193 bp, Arabidopsis thaliana
  misc_feature: Ceres CLONE ID no. 118878
  misc_feature: Encodes the peptide sequence at SEQ ID NO. 1195
  misc_feature: Encodes the peptide sequence at SEQ ID NO. 1202
atcacttacttaacatactaagagagttattagaacttgcaaaaaatggcttccaaggctttgattctgttaggtctcttctcagttcttctcgtcgtctccgaagtgtctgccgcaaggsaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggagggcactatggaggaggtggaggacactacggaggtggtggaggaggatacggaggtggaggaggacaccacggaagggcggaaagcactcccctaaagcccctaagctaccagttcctccggtgaccgtccctaagctaccagttcctccggtgaccgtccctaagctaccagtccctaagctacccgttcccccggtaactgtacctaagctacccgttcctccagtgaccgtccctaagctaccccttcctccgatttcagggctacccatacctccagtggtaggtcccaatctgccattgccacctttgccaattgtaggtcctattcttccaccgggaacaaccccaccagccacaggagggaaggactgtcctccaccgccagggagcgtaaagccaccatcagggggcgggaaggcgacatgtccaatagacacgctgaagttaggtgcttgcgtcgacttgttgggaggtttagtaaagatagggcttggggatccagcagttaacaaatgttgtccgttacttaaaggcctcgttgaaatcgaagccgcggcttgtctctgcactaccctcaagctcaaagctcttgacctcaatctttatgtccctgttgctcttcagcttctccttacctgtggcaaaaatccacctccgggctacacttgttccatatgataaactcactccacttataaaggatgctttggaaaaaaaagtgagaagagaatggcagagctccaatctttcctgtcttggtttaccaaatacatcatatcaaatcctatccctttgattctttcctctatcgttcccttatgcttgtatcattaattaatgtgtgctttttagattaatgattcttctcttgtattaaagtatgatttgaaatcctttttttttctc

SEQ ID NO: 2381 - DNA, 1521 bp, Arabidopsis thaliana
  misc_feature: Ceres CLONE ID no. 142681
  misc_feature: Encodes the peptide sequence at SEQ ID NO. 2037
aaaaataacttaatcacacacaaggagagaagagagaaagagagaaagagagacagagataatggcgtacagtgcgtgtttcctacaccagagcgcattggcttcatcagccgcacgatcatcatcttcctcctcatcccagcgtcacgtgtcgctctccaaacctgttcagatcatctgtaaagctcaacagtctcatgaagacgataactccgccgtctcccgccgtcttgctctcactctcctcgtcggcgccgctgctgttggttccaaagtatctcctgctgatgccgcctacggtgaagctgcaaacgtgtttgggaagccaaagacgaacacagacttcttgccatacaatggagatgggttcaaagtgcaggttccagcaaaatggaacccaagcaaagagattgagtatccaggacaagtccttaggttcgaagacaacttcgatgctactagcaatctcaatgtcatggtcactcctaccgacaagaagtccatcactgattacggttctcccgaagagttcctctctcaggttaattacctcctagggaaacaagcttacttcggtgagactgcctctgagggaggctttgacaacaatgcagtggcaacagcaaacattctggagtcatcatctcaggaagttggtgggaaaccctactattacttgtctgtgttgacaagaacggctgatggagacgaaggtgggaagcatcagctgatcacagcaaccgtgaatggagggaagckttacatctgcaaagcacaagctggagacaagaggtggttcaagggagccaggaaatttgtcgagagcgcagccacttctttcagtgttgcttgmgtgaaagcaacacaacgtaacaatgctctgcttgctttcttcatttgtctcttgtaaaaaatggaaaatgaaactgagcttttgagaactatcaagatgatgttaccttttcggcatcacttgtgtacctatgataccagactcgtttccaagttttcttaaaaaacaactayattcaatagatattttctcmmattwaaaaaaaaaaaaaaaaaaaaaaaaaaaaaaaaaaaacaaaaaaaaaaaaaaaaargcttctcgkgccgttttttttttttttttttggagtttttggttggacggtggagattggagaagctagaaggattgacgggtgagggccaacgtgcacaggagtttgtgtgtgggttagctcagaggattagacgccttcaagagcgtgcagacgagagagctaagaagcttaagaagacccatgaggtttgctttagttggatcttcgataagcagattagtgtgtaaactcttgaaaatatcaaacttttcctttctccgtttcttgtttttttactctaatgaggcctactcatggttgtgtgagtggttcctcaagtatcattgtccaataaggagccaatttatttatggctggctgttttattacaaattatgtgtatgtgttaataattaaagattgaattatctac

SEQ ID NO: 2382 - DNA, 1813 bp, Arabidopsis thaliana
  misc_feature: Ceres CLONE ID no. 148506
  misc_feature: Encodes the peptide sequence at SEQ ID NO. 385
ctcctttagagagagcgtgccatttttatttttctctttcttctctcatttttattttcttttcttttttttcacctttttttttcctttttttttctttcttcttcttcttacttgattttgaaccctagcttaaggggaattttctcgggaaacaaaagagatatttttatcgcagtgagaaagaaacacaaaaaatgcagaatcaaaggcttattaagcagcaacaacaacaacaacaacagcaacatcaacaagctatgattcaacaagctatgatgcaacaacatccttctctttatcatcctggtgttatggctcctcctcagatggagcctttaccaagtggaaaccttcctcctggttttgatccaactacttgccgtagtgtgtatgctggaaacattcatacgcaggtcacagagattcttcttcaagagatttttgcaagtactggtcctattgaaagctgtaaactcatcagaaaggataagtcatcatatggatttgttcactactttgatcgaagatgtgctagtatggctataatgactcttaacggaaggcatatatttggacagcctatgaaagttaattgggcgtatgcaactggtcaaagggaagatacatcaagtcatttcaacatttttgttggagatcttagtccagaggttactgatgcagcattgtttgatagcttttctgcttttaacagctgctcggacgcaagagtaatgtgggaccagaaaactggacgctcaagaggctttggttttgtttccttccgtaatcagcaggatgctcaaactgccattaatgagatgaatggtaaatgggtaagtagcagacagatcagatgcaactgggcgacaaaaggtgctacttttggcgaggacaaacatagctctgatgaaaaaagtgttgtagaacttactaacggatcttcagaggatggtagagagctgtcaaatgaagatgcccctgaaaacaatcctcaatttacaactgtctatgtaggaaatctctctccagaaataactcagcttgatctacaccgtctattctatacccttggtgctggagtgatcgaagaggtccgtgtccagcgagacaaagggtttggttttgtgagatataacactcatgacgaggctgctcttgctattcagatgggcaacgctcagcctttcctctttagcagacagataaggtgttcctggggaaacaaaccaactccatcaggcacagcctcaaacccacttcccccaccagccccggcatcagtcccttctctgtctgcaatggacctcttagcctacgagaggcaactggctctagccaagatgcatcctcaggctcaacattctctgaggcaagcaggtcttggagtcaatgttgctggaggaactgcagctatgtatgatggtggctatcagaatgtagctgcggcccatcagcagctcatgtactatcagtaataaaccctcttcactggctctgagatacctttttctgtttctttctttttcttcttcttaattttataactttcttgctttttctagaccttccttgttcaagagtctttatgtatgtgtctctttcatttaaagccgttggttttatttatgtatgcagagctttatgctcagtttgtaacctataggtcttacttggattgtaagccaagcaataagacaacatcaaataaaaggggatttggttttctggggttaatgttgtttgtggttctgtaatgataggtttgaaacaaagtaatttgtcttttataaaagttttatagtttcatttc

SEQ ID NO: 2383 - DNA, 1064 bp, Arabidopsis thaliana
  misc_feature: Ceres CLONE ID no. 158765
  misc_feature: Encodes the peptide sequence at SEQ ID NO. 839
ctctttccttttctcacgccgagatttctgcgactgctctagtcttacgaccttataagaaacgacgctattttcactctgcttgagctcttcatcgtgtcacacagcacgatcttggacgtcgttttaagcgcaaaacaaaggaaaaagactgacgtttatacatactaaataccggtttggagttttgccttttggactcagaaaactcaaaagagagagagagagagagacatttctgtatcttatcgggttttgtgttgtcagaaagaagctcaaggacaaaaaaaaaagcaattatttttagggttcaaaagaagcaaaatttggaactttcagaagttgtgggtggtggcttcttgaacaataaagctttttcttagactcttcttccaatttgtgactctacctatctctctctccaggtatggaattctctggagacgctggaatgatgatggagaacaagcggaatgtctgctctctcggagaaagcagcatcaaacgccacaagtctgatctctcttttcaattccaaggagaggaaggacaaggttggagaacgtatttcagctcttcaacaaatagtttccccttatggaaagaccgacactgcatcagttcttctagacgcgatgcattacatagagtttcttcacgaacaagtgaaggtgctaagtgctccgtatctgcaaacgatacctgatgctacgcaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaactgctcatggttggcaatgattgttattattatttgactgcttaatgcatccccttactttg

SEQ ID NO: 2384 - DNA, 973 bp, Arabidopsis thaliana
  misc_feature: Ceres CLONE ID no. 207075
  misc_feature: Encodes the peptide sequence at SEQ ID NO. 1982
gaacaatattcacagagattttcgatcttaaccgagaaaaggaagaaatggctggtccatcgacaacttcaaacgcaccaaagcagaggaagagagtcgaagccgagactagcagcaacacttctactaccttacgtcgcgctaaagacggaagcgctttcgctctctgtgaaggatgtaacaagagtgtagctgtagcgcttataagcatgcacaattgcagtctcgatgctaagatcagagtgaatctcgaagcacaagttgtggagacacaagcagaggctaagaagaagcctgcagagaagaagaagacaacatctgatggacctaagccaaagagacttaagaaaaccaatgatgagaagaagagctcttcaacttcaaacaagcccaagcgacctctcactgccttctttatcttcatgagtgatttccgtaaaacgtttaagtcagagcataatggttcattagctaaggatgctgcaaagatcggtggtgagaagtggaagtctttgactgaggaagagaagaaagtttatctggataaagctgctgaacttaaggcagagtataacaagtcactggaaagcaatgatgctgatgaggaagaggaagatgaggagaagcaatctgatgatgttgatgatgctgaggagaaacaagttgacgatgatgatgaagttgaggagaaagaagttgagaacacagatgatgacaagaaagaagctgaaggtaaagaagaggaggaagaagagattttggatgactactagaaatgttatgctcgttcttgtgggtctagtcttactgaaatcggtttatctctaatcgttgcgatgcattgtaaatgaagcctttattagtgaaagtagtttatttgaagttaagttgtgagcaagtggtttttttgtagttcactgaaatggtaatgccttttgtttaaacaagtaatgaagcttatgtttttcgtttt

SEQ ID NO: 2385 - DNA, 1603 bp, Zea mays
  misc_feature: Ceres CLONE ID no. 212775
  misc_feature: Encodes the peptide sequence at SEQ ID NO. 1936
aattcatcaacgcagcgcgtcgcctaccgctcaaactccctatgcttcctcccctctctagcggagctgcaggagcaccacccctccaagtcggcgtctagaatccattggacgctcaagtacgggaagctggtctaagaggggaaggtaccaggtggtttgcgcgggggcgccatggaagttgtgctcgctccggcccagcacgacggcctgcacgcggcgtttgggcccaatcccttcgacatcggcgttggcggagatgggcggatctcttcgagcctctcctcgctcggcggcgatcgcttctgcggctactccaccaccgcctccctcttcgttaatagccccgggctgtcctcgccgtcgccgcgcgccgactcgctgtcccgcggttcctccgactctggctccgtcgtcgacgacggggacgatgcggcggccaccgcccccagcgtcgcggagcgtcgactccgcctcgcgcgcctcgcgctccagtaccaggaggtggtcaaccgcttcgagctctgcctctcgtacctcgccgacgccatcaacgaggcggccgcgctccgccaggagaacgatgagctccgcgtcgccaacgagtacctcgcccgccgcatcaacgtggtcggcggcaggctcgccgacgagttcagcggtctccgcctcgccgaggagcacaccacgccacctcctctgtcaccgctgcccgccgcgccggtgatgccgaagagcatctccgttcgctcgcccggctatctcaagatgatccagaacggcaagcatcgggcgtccaagccaacgaagggctcgcgcgtgttagtgggcatggaaggcggagtgaaggaggaggagaagctcaacggcgggctgcagttcgaggtgtacaaccagggcatgctgaagacagagctgtgcaacaagtgggaggagaccggcacgtgcccgtacggtaatcagtgccagttcgcgcacggcatcgccgagctccgccctgttatccgccatccgcgctacaagaccgaggtctgccgcatggttctcgctggcgttgtctgcccctatggccaccgctgccacttccgccactccatcacccctgccgatctcttcctcccgcgcccttgaatatgtcagaccaccacccactgccactgtctcgtccgcttccaccctctccaactctacttcattgtgcggttataccatcgtcagtcttcagaacccaaaaaatgtctgattagttgtgattcagaaaatgatagccgtaaataagctatagatagatacacgagatggaaaacgaaaattgttctacgtaattagcacacaggcaagatgtgaatatgtagttctagacacccaaggtattcatatggggttgatcagggcaatcaaactcaaatatgagttatgttgggattattgtattcgtcgtatcgtttatatacacagtttaggttacgatgttctgcctagttacattttttccgggcaaattggatgacaaactggtgagttcatgtaagtaaactaaggctgttatctgaatatctctgatgtgttgaacactggcaaaaacaagcaccttctccgttgt

SEQ ID NO: 2386 - DNA, 1216 bp, Zea mays
  misc_feature: Ceres CLONE ID no. 218484
  misc_feature: Encodes the peptide sequence at SEQ ID NO. 428
acgtttctttaccctaaacttttcactgcttcgtcgagggcagagccgccgccgtttctcaatctcctcgcagcgccggcgctccatcttcgctcccttccttactcgctctcggcacgcaggcggcggcgctgggctctcggcacgcaggcggcggcgctgggctctcggcacgcaggcggcgacgctgggctctcggcgaccgcgtcagcggcttcccctccggcctctcgccagtcaccgcgcgccctcgcccctggtcctctgcacaccggccggtggccctgcgtgcttgcccttctctctcccctcccgcctccggtggatcgtcaacggcgcccggccccggcggcagcgcggcgcgcgatctcgagggcagcgggagccagcagccgctgctccaccaaggcggaagcaaagcgttacccttcctcttagcgcttcagcgcgctgacgcgtgcgcttagttccgccttttggaaccctgaaccctgagctttaagaagacactactgctgcaaccatgagcaccatgaagttttgtcgcgagtgcaacaacatcctgtaccccaaggaggacagggacaggcgcaccctgttctttgcatgtcgcaactgcgagcatcaggaggtctctgacaataactgtgtctatcggaacgaggtgcaccacactgctggggagcgaacccaggtcttgcaggatgtagcttctgatccaactcttcccagaaccaagactgtccgctgcaatctctgtgggcatggagaggctgttttcttccaggccgcagcaagaggggaggaggggatgaccctgttctttgtgtgctgcagccctgattgtggtcatcggtggagggaatgatgcgatgaaatcttcgctctaatagttgtttcatcagagcatgaaacttaacttgttttgtagttttcttggaactatgtatttcgaatctgtcctaagattaatgagagaatgtctttccaatattttatttaattctacgtatatatgatatgtagctgcaaccacatagtacgtagtctcatatgcttgttctgccccagaactcagagagttaggaggagcaaataaggtattcttaatgagttaggaggtgtttagttggctctgcctagagttttggagactcacatacttgctctcctaaatgggggactcttcgctttatgtacattttttccctcttct

SEQ ID NO: 2387 - DNA, 1295 bp, Zea mays
  misc_feature: Ceres CLONE ID no. 236111
  misc_feature: Encodes the peptide sequence at SEQ ID NO. 639
aactcccgattcccgaaggcccatttcgtcgtctcttgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaggtttgtgctcaccagagcaaggatttcaaggaaggctgcggcgatagcgaggtagatgacacggcgtcctgtcgcgatggtggtgctatcaattttcaactgactccgaaggagaacagacaaccgaaggatttgacggcttgcagggtctgcaaatcaagtgaggcatccatgctcttgctgccttgtcggcatctttgtctatgcaaggagtgcgagagcaagctgagcttctgccccctgtgccagtcctccaagatacttggcatggagatatattatgcgtagaatagaatttatgtatcacatgagtatcgtacgagatactgctatgttaatacgattaatctattgccaaactttagaacctatgtaccagtaccactatgacttgccactggatcaaaagacactgccgttgatggtagatttaccgcagcaaatttctgtgagaagcccatcgttgatttgtgct

SEQ ID NO: 2388 - DNA, 2575 bp, Zea mays
  misc_feature: Ceres CLONE ID no. 236189
  misc_feature: Encodes the peptide sequence at SEQ ID NO. 951
gatccggccacgctacccttccgtcgctcctccggtcctccccacccacgacccctgccggaagggcaaaaggggctcgaaatcggtcccctgatccaggagccaatcttctagttctcccaaatccttttccggatccgaactgcaagtcctccttcgcgaccatggatccacgcgccaggtatccttcggacatgggcaacggccgcggtgggacccctaactactacggccgcggcccaccgccgcaacagccgcatcagcaccaccaccagcagcagcagcagacatcgggggcgcatcaccaccagcagtacgcgcagaggcagcagcaacagcaccgccacagccacaaccaccagcagcaacagcagcagcaccagagtcagcagcagcagcagcagtggctgcggcggaatcagattgcccgcgaggccgcgggcgcagccgtgaccagcgagccgaaggccctggcgccatccacggccgccgacggcgtcaattcgagttcgcaagattggaagacccaattgaagcttccgcctcctgatacacgctacaggacagaggatgttacagccaccaagggaaatgagtttgaagactattttctcaagcgtgaactcctaatgggtatttacgaaaagggatttgaaagaccctctcctattcaagaggaaagcattcctattgctttaactggtagtgacattcttgcaagagcgaagaatggaactggcaagactgctgcattttgtattcctgcactggaaaagattgatcaagaaaaaaatgctattcaagttgttatattggttcccacaagggaattggctctacaaacatcacaagtttgtaaagagcttggtaaacatttgaagatccaagttatggtcaccactggtggaaccagcttgaaggatgatattgttcgtctgtaccaacctgtgcacttaattgttggaacacctggccgtattttggatcttacaaagaaaggtgtttgcattttgaaggactgttcaatgcttattatggatgaggcagacaagcttctctctcctgagtttcaaccttccatagaacagttgattcgctacctccctgctagtcgacagattttgatgttctcagcgacattccctgtgactgttaaggagttcaaggacaaatatcttcctaaaccttatgtgattaaccttatggatgaacttacactgaagggaattacgcagttctatgcttttgttgaagaacgacagaaagttcactgtctcaacaccctcttttccaagcttcaaatcaatcagtcaataatattctgtaactctgtaaatcgtgttgaactattggcgaagaagatcacagagcttggttattcttgcttctatattcatgcaaagatgctacaggaccaccgcaatagagttttccatgatttccgtaatggagcgtgcaggaatcttgtttgtactgatctttttacaaggggaatagatattcaagctgtgaatgttgttatcaattttgatttccccaagaactctgaaacatatctccacagggttggtagatctgggagatttggccaccttggtctggccgttaatttgatcacctatgaggatcggtttaacttgtataggattgaacaagagcttgggactgaaataaaaccaattcctcctcagatagaccaggctatatattgccaatgatcaggcagttttcatctttgttcatttctccgtgattaataaggagacaacttttgtaaataccagctcatcaggttttatggtgttgatctcatttggtgcatcggagacaattctaagttggttgattacgtgagacgaggcacccgacttttcctgatcaccttgtcatgctgacactattatggctatatgggggaaaatgtcctgccacactaggcacaaagtagtgtatattgctaggtgcctattcctagaccctgtcctgctttgagttcgtttgtatttcccttgttttccgtacgccgtgtcgttaagcagtttcacacaggacattttaaccctgttgctggttctgggcgtgtggcctgtgggtgccgcgcacaagggtaaaagacattttagcccaagtggaacttggggatgtgcgcctcagattggttaatgggtgtgacaagtcggccatcgcacttgaggtctggagtctgaacggtagtgaagtggttttaagtttgccaataatcggtggtaagctgcaccgtgctgtgctgtcttttacccttgcaaccatgtccctttgcttcttggcatggtcgccatttagattctgtccggcgaatgtaacgctgggataaaacgttcttgtcgtttgtgatggatttatgtgtttggcacaagcaacttggccaggttatgggtaccagaactgtctacttgtttcttccataataacaaactttgcagctctttttgtactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2389 - DNA, 1341 bp, Zea mays
  misc_feature: Ceres CLONE ID no. 237390
  misc_feature: Encodes the peptide sequence at SEQ ID NO. 1798
gcagctcagttactcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggtgcgtcgttgcgaacacacatgaccgctcaactaattaactcccgttcgcctgctgcgccctttttttccgttttaaaacgtctaatgcgcgcggcgcggaatgtaatgcaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatctcaacctctctctctctctctctctcgctcgctctacatgtgtgtgtacctttctcttcctttcacctgcctgtctcctccctagatctgagatcatgtggctagctctcccatatcaaaatgtactagctacacgcgcacgtatggtggtggtctctgctaagcctaagcttcactgggtagtagggtactagtagcactaggggcttaagcaagctaagcttatcctcctcatcagaatcacattagctcgcaccgcactctctggcttctcgtcgatcgtcttcgtcgtcctcgctcctccgacccacatgatggctagctctccatgtgccgcttctcctctcgcacgtgccgcttctcctcttgtgttcgatatgttgtattgtttccatgtaaatttagtcggtggcctggatcgagttggctagctctctctacaggcaagagacaaccgaccgaccactactatcctagagcaaattgattatcgtcatgatggtgtactgttcaagcttttattaacgacttttaatttacttgctacgtac

SEQ ID NO: 2390 - DNA, 1054 bp, Zea mays
  misc_feature: Ceres CLONE ID no. 239853
  misc_feature: Encodes the peptide sequence at SEQ ID NO. 1041
ctctcctctctctcccaacggacccgatctcgtacctcacttccgtcccgcccagcttcgcttcacggcgcgccgaccggcttggacgcgccgaccggctcgtgatcagctcggtcggatccgacggtcgctcgctgctgcagcgggcgcttgctgtgcgtcgcgtgggctcggccggagcccggagggaggcggagccttccccgggtctcgaagatggcggcgccgccggcgagggcccgggccgactacgactacctcatcaagctgctcctcatcggcgatagcggtgttgggaaaagttgtctccttttgcggttctcagatggctctttcaccactagctttatcaccaccattgggattgacttcaaaataagaacagttgagcttgatggtaagcgcgtaaagttacagatatgggatactgctggtcaagagcggtttcgaactattacaaccgcctactacaggggtgcaatgggaattttgcttgtctatgatgttactgatgagtcatctttcaataatataagaaactggattaggaacatagagcaacatgcttccgacaatgtgaataaaattttggtaggcaacaaagctgacatggatgaaagcaaacgggctgtgccaacttcaagagggcaggctcttgctgatgagtatggcatcaaattttttgaaacgagtgcgaagacgaacctgaatgtggagcaggttttcttctccatagcaagagatatcaagcaaaggcttgctgaatctgattcaaagccagaggatcgcacgatcagtatcaacagacctgagggtggtgaggcttcagcgtcacaaaaatcagcttgctgcggatcgtgacggggttacattgtcacaaggaagataaatagtgcgataccatactttgtaatttacccttctacgtaccttttatctggctgtcatcgttctcgtctagcttttaaatgcaattgcttggattcaggtttctgtgttgtaatgtgaacaattttagttgtacccctggtagaaatgcatgtgctcataagcc

SEQ ID NO: 2391 - DNA, 1203 bp, Zea mays
  misc_feature: Ceres CLONE ID no. 240510
  misc_feature: Encodes the peptide sequence at SEQ ID NO. 1234
  misc_feature: Encodes the peptide sequence at SEQ ID NO. 1992
accgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggtgagtgctcccagtcaagcgcctcttccttcgtagtgtcaacaattccgccccgcgcccgcgcggatctgattgtctcgatcgtccaatcgagcggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgaggatgagctgcgtgatgccgtgctgcttgtatttgcaaacaaacaagatcttcccaatgctatgaatgctgctgaaattactgacaagcttggtctgcattctcttcgccagcggcactggtacatccagagcacttgtgctacatctggtgaagggttgtatgaggggcttgattggctttccaacaacatcgccaacaagtcttgaagcttttcagcagggctcctagcaagaggaagacgtctgaacaacttatggatgcttttttacattttattacaaagatactccctctgtctcgatttactattccttttgggatagtggttgattcatataatatttgatgtatgtgtttaatagatgtgtctagattcaccatcatctattttaatatggacatagatataaagagctaaaacaaatactattttgaaatggagtgagtacaatctatagtagatagtgtgggtgctgtggagagaaaaaaatctgagctttcttttgagtgtttgctagtgtttaccttcggagatgatatggtaaattatattgacatgctct

SEQ ID NO: 2392 - DNA, 1642 bp, Zea mays
  misc_feature: Ceres CLONE ID no. 243130
  misc_feature: Encodes the peptide sequence at SEQ ID NO. 745
gaaaaatagggacaccacatcattgccatccgcatttcgtcctcatgttcttgttatcttgtagctccacatccaccatcccactctccctattcttcttctcttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatccctcttgaagagagtgagaactcgatagatcaagaatcaccacacgttgtattaatcgtatggtataatatttatacatgtacaggatgagc

SEQ ID NO: 2393 - DNA, 1076 bp, Zea mays
  misc_feature: Ceres CLONE ID no. 245683
  misc_feature: Encodes the peptide sequence at SEQ ID NO. 2015
aaactagggctcaaaactaacttcaaaaaaatcacccactaaaagcaccttcctcttcctcttcctccgcccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcatttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaatttattgttc

SEQ ID NO: 2394 - DNA, 989 bp, Arabidopsis thaliana
  misc_feature: Ceres CLONE ID no. 256151
  misc_feature: Encodes the peptide sequence at SEQ ID NO. 1014
ctctttttctgcgcactccttcgtttccaactaacgtgcgcagtgtatcctatctgattcttccgattacatcggttttcttctctctccgattcaatggctgctccacctgctagagccagagctgattacgattatctcattaagcttcttttgattggagatagcggtgttggtaaaagttgtcttctactacgtttctctgatggatctttcaccactagcttcattaccactattggcattgactttaagataagaacgattgagcttgacggtaaacgtatcaagcttcagatttgggatacagctggtcaagagcgatttcggactatcaccactgcttattaccgtggggcaatgggcattttgctggtgtatgatgtcacagacgagtcatccttcaacaacattaggaactggattcgtaatatcgaacagcatgcttcggataatgttaacaagatcttggtagggaacaaggctgacatggatgaaagcaagagggcagtacctacagcaaagggtcaggctcttgctgatgagtacggaattaagttcttcgaaacaagtgccaagacaaacctaaacgtggaagaagttttcttctcaatagggagggacattaagcagaggctttcaracaccgactcgagggcagarcctgcaacgatcaagataagccaamcggaccaagcaactggagcagggcaggccacacagaaatctgcatgctgtggaacttaaaaaagttttaaaagtgaagtttaagtcgaaaaaagtttgggggtgaagtgaaaaactaagatatcgttgggtgcttatgtaatttttttgttttatgccaacaattctgattcgttcttctaaattgtccttcctatttgtacgaaggtttaatcgaaacttgtatttttcttttctattactgattttttatgacggtgactgaattgtttatgttggtcatcacttctctctatatatcc

SEQ ID NO: 2395 - DNA, 570 bp, Zea mays
  misc_feature: Ceres CLONE ID no. 272426
  misc_feature: Encodes the peptide sequence at SEQ ID NO. 2017
aaaagccacctccccaaacccaatcccgtcactatctcattcccctgaccgccggaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaagg

SEQ ID NO: 2396 - DNA, 1034 bp, Zea mays
  misc_feature: Ceres CLONE ID no. 273307
  misc_feature: Encodes the peptide sequence at SEQ ID NO. 1309
ctctccttccttcacggattcccaaatactcgcttccaataccaattctccgatccacgttcgttcccgcaccctcgcgctccgctgatccggcggcatgcggcgccgcggcgtggcggcggctgatgcggacggtgacgtggagttgcggttccgcggggtgcggaagaggccgtggggccggtacgcagcggagatccgggacccggcgaagaaggcgcgcgtctggctcggcacattcgactccgccgaggacgccgcccgcgcctacgacgccgcagcgcggatgctgcgcgggcccaaggccaggaccaacttcccgctccccgccgcagccgccctccaccacccccacatgcccgctgctgccgccgcagcagctccaccatacacaacatatcccaccgccacgggcgtcgtctcgacgccgccggtcgccagaccggcttgcagcagcctcagctccaccgtggagtccttcagcggcgcgcggccgcggcctgtgctcccgccgcggttccctccgccgtcgattcctgatggcgactgccgcagcgactgtggttcctcggcctcggtcgtggacgacgactgcacggacgcggccgcctctgcgtcgtgccccttcccgctcccgttcgacctcaacctgcccccaggcggcggcggagccggcgtcgggttttacgccgatgaggaggatgagctcaggctcacggcgctgcggctgtgacgtcgagctcaatcgagccgctgcttagaaagaggaaaaggagaaaaatatttggttcttcccttctcttgtagccgacacgaactctccatccactacgatgttgttgtttacttgatctgattatgatatttgcctgaatcctagtcaacttacctgcatgcatgcctgcttgttttctggcgattgaggattatcgccaaacgccaaatcttgcagcagctgttgtactgtaatatatcaacattttacttccttcctcttatgaggaaagagacagataaagtaacttatttcaatc

SEQ ID NO: 2397 - DNA, 484 bp, Zea mays
  misc_feature: Ceres CLONE ID no. 276776
  misc_feature: Encodes the peptide sequence at SEQ ID NO. 1233
  misc_feature: Encodes the peptide sequence at SEQ ID NO. 1990
gaaatgctggaattcctggacgcaaaaaaatgttaattgggtaaacgctgcggacggtctcagcccgccacgcgacaaccgacaatccttcgcagtcccgcaccgcaccgccgcaccgcaccaccgcaccgsccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcgtctgaggaaggcgttcaccaccgtcgcggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaactgttg

SEQ ID NO: 2398 - DNA, 1250 bp, Zea mays
  misc_feature: Ceres CLONE ID no. 281395
  misc_feature: Encodes the peptide sequence at SEQ ID NO. 128
atataatttatggatggaatgacaagccaagctcacttctggtgaaattgcagatctcaccttagttgcctcctccgtyttcgctccctccgcagcgtcagatcggccgtcgctcgccgagccctagcgccgccgatctcagcccgtaccagtcttgcagatcggggtcgcgccgcggcggcaagaacgatggccgaggaggccaagtacctggagacggcgcgggccgaccgctccgtgtggctcatgaagtgccccccggtcgtctcccgcgcctggcaggccgcctccgcctccgcctcttcctccgacgccgctaacgccaaccccgttgtcgccaaggtcgtcctttccctcgacctgctccgcccagaagaacgccccgaagagcgcccggaagagcccacgctccagttcaagatggagttggcacaaactaacactgggaatacacctaagagctactctttgaatatgttcaaagatttcgtgcctatgtgtgttttctccgaatctaaccaagggaaactttcatgcgaaggaaaagtcgagcataaatttgacatggaacctcacagtgataatttggcgaactatggaaagttatgtcgtgaaagaacacaaaaatatatggttaaatctagacaagtgcaggtacttgacaatgaccacggtatgagcatgagaccaatgcctggcttggttggtctcataccttctggttcaaaggaaaagaagaaacaagcaccagcgaaaccatccgatgtcaaaagaactcgtagggatcgtacggagatggaaaacattatattcaagctttttgaaaggcaacccaattgggcactaaaggcgctggtgcaagaaactgaccagccagagcaatttctgaaggagatattgaacgatctctgtgtgtataataaacgaggaccaaaccagggaactcatgagcttaagccagagtacaagaaatccacaggggacactgatgctgcttaaagatgatagacgacttggttgtttatgtgcagaatcgctagttctctgtcggtaactcgggcacacaaacacaagcgtgatctagttttatttgtatgctttaagaggtgttatttgtaagctggatacacatttgtttagagaggaaaaggggaaagataattgaaacaaaatgtaagagtctaaattgttggaccaatgttctttatcgggtattaaatttagtcagttggaagtggagtgaataggcg

SEQ ID NO: 2399 - DNA, 1388 bp, Zea mays
  misc_feature: Ceres CLONE ID no. 282666
  misc_feature: Encodes the peptide sequence at SEQ ID NO. 1641
  misc_feature: Encodes the peptide sequence at SEQ ID NO. 1756
gttcaattcgatcacttcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccaccacctcctcggactcctcctcgtcttcggccagcggctcgcacaagaggcggaagcgaggcgaggccgcggctgccaacatggccatggcgctggtgccctcgccctcccagcttaaccggccggcccagccgtggttccctgccgcgccggtcgagcaggcggcgatggctccgcgcgtggagcagatcgtcgtctagtctagccatgcgccggcgaaagcgggggcaaggccctgcgctgcacttgcgtgacagctccaccggatggaatgcgaatatgcgataaagctcgggagcaactggggtccgtccggatgccgctgttgctccgtgcaactggcgcaagtggaagaagctgtctattggaagtcaaattgagccgcgcggacagtccggcgctgaggccggacggtccgcggtccggacagtctgcggtggtggcgcggacggtccgcgcgcgcgcagagtcagttagggttcctagtttctcgcgggatttgttacctaaaaccgcgggattaactcgggaaacagttggaaacggatccagacctccccctttatatagatgaaggtctacggccgattgaaccccaacaatcgaacaaatcaagtctatttctcgttttt

SEQ ID NO: 2400 - DNA, 1158 bp, Zea mays
  misc_feature: Ceres CLONE ID no. 282892
  misc_feature: Encodes the peptide sequence at SEQ ID NO. 850
cttcaattcttccccaacgcaggctcttcccccgcacagcagcatctttcttctcctcttcgcggcgcgtcctccgggttaaggaaaaaaaagcggggaaaagggagaagaatcgcacgtcccgccgccgcccgctctgctagtgctagctgctgctggtttggtcgtttcccggccgccgcgccggtgacgcagatcgacagctcctgcccatctcagagtccatcgccgctgatcctgcctgtgcctgcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagaagccgaggaatagcaacagcccgagaaccgcgcccgtatcgcccaaggagaagaaggacaggatcggcgagagagtcgcggcgctccagcagctagtgtcgccgttcgggaagacagacacggcttccgttctccaggaggcgtcggggtacatcaggttcctgcaccagcagctccaggtcctcagctccccttacatgcgtgctcctccggctgccggcgccgcgcctgaggataccgagcactacagcctccggagccgcgggctgtgcctggtgccggtggaccagacactgcagctgacccagagcaacggggccgacctgtgggcgccggcgaacacgaccaggcgcaggtgaggaggagcctgctgccggcctgtgcctggtggtggtctgcccggaggaaaccgcgcaagtactactgctgtgtctgcatggtgcgcgtgtagtacagtttccaagcgcctgacccaattcgatctcctaacaagaagctaagcattaagcaagcgtgtccgtatcagccgccttgtattataccagtgacctgtcggcgccgtatatgtgtgatctgcttgctagctgatccacacagatggaagcggccctgaactgcgtctccatgtggtactagtactatgtaactatgtgtttactgacttgtgaactagcagtctgtggcctgtcagcaagtaaatgggggcagtttaatac

SEQ ID NO: 2401 - DNA, 1632 bp, Zea mays
  misc_feature: Ceres CLONE ID no. 287677
  misc_feature: Encodes the peptide sequence at SEQ ID NO. 1746
actcgcgtcgcacggatctctccttccctccaggctccagctccaaagcctcgtcgccttcttcgccccgccacccgtcctgcacactcacaactagacatcgtaccacccaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccgccaccatatgtcatgtacccccctggagtatatgcccacccatctatgcccccgggtgcacatccatttactccttatgccattacttctccaaatggcaatgctgatgctactggaactactgctgcagctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacaaggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaaggcaaacaacacaaaactgatgaggctggacttaacaacaagctgcaacattctgctgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctgttagaaatagtggataaagtcaaacttacaaatttgaagtgctgactaatattgttatgtatacctggcaaaagactggttttctttc

SEQ ID NO: 2402 - DNA, 2103 bp, Zea mays
  misc_feature: Ceres CLONE ID no. 290675
  misc_feature: Encodes the peptide sequence at SEQ ID NO. 960
acattggaacgcgaacgctctcggatccatccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaggcggtagtggaggaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcagcttgacgctgttgactcgagttctcaagattggaaggctcaactaaatataccagctccagacacacgctacaggacagaggatgtcactgcaacaaaaggcaatgagtttgaggattatttcttgaaacgtgagttgcttatgggaatatatgagaagggatttgaaaggccatctcctattcaagaagaaagcattcctattgcgttgactggaagtgatattcttgcaagggcgaaaaatggcactggaaagactgctgccttttgcattccggcacttgaaaaaattgatcctgaaaataatgcaattcaagttgttatactagtaccaacaagggaactggctctgcaaacttcacaagtgtgtaaagagcttgggaaatacctaaacattgaagttatggttagcactggaggaaccagcttgaaggatgacatcatgcgtttataccaacctgttcatctactcgttgggactcctggccgaatacttgatcttaccaggaagggcatttgtgtgctgaaagattgttcaatgcttgtcatggatgaggcagacaagctattagctccagagtttcagccttctgtggaggcacttattcatttccttccacctagtcgacaactgttgatgttttcagcaacctttcctgtaactgtcaaggaattcaaagagaaatatctgcctagaccttatgtgattaatctaatggacgaactgaccctgaaaggaatcacacaatattatgcttttgttgaagaaaggcagaaagttcattgcctgaatacacttttctcaaagcttcaaattaatcaatccattatattctgcaactctgttaatagagttgagctgctggctaaaaaaataactgaactcggttattcatgcttctacattcatgctaagatgttgcaagaccacagaaatcgagtatttcatgattttcgtaatggtgcttgcagaaaccttgtgtgcacagatctgtttaccagaggaattgatattcaggctgttaatgtggttattaattttgacttccctaagacatctgagacatatttacacagggttggccgttctgggagatatggacaccttggtttagcagtgaacttgatcacttatgaggaccgtttcaacttgtataggattgagcaagagcttggaacagaaattaagacaatacccccgcagatcgacctggccgtatactgccaatgatgaatgcgacattcaggagcatcaaacacttctctttctatttgagaaacttatcaggcaaatacgtttgtacatagcaacccatcagggctttgttttggcaccttgatgacgtttgtaagcttacctggattagtagaggaagtgcttcctgtaggcactgatactaacccgtttagctgaggacatgcacgctgggctgcttggaggcccagaactatgatgagatgagacaatatcttacctcacttgacattttcactcgacttgtttgccagtctcagttctacttgacttgcctgttctcatttgattcatcttccgttttcttctttcctaatgttatgatgcatatggatgtctttctgtagctgtatgatgtgttgagtttattttttcttggtgtatgtatacagcttaacttgaaattatttccatatcaacttctttgc

SEQ ID NO: 2403 - DNA, 1217 bp, Zea mays
  misc_feature: Ceres CLONE ID no. 291139
  misc_feature: Encodes the peptide sequence at SEQ ID NO. 908
aagcatacacacacacgcgctggtttagactcagcacacagcattcattcagctagcgagcgagagagaggggaacaaaaaggaagggcgaggaggacagggagccgagcgcaagagctgaggcttcgccgcgaaaccccagacctcgcgccgccccttcccctccgcggcgtcgtcctcgcacgctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctgcaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacaataaattccgtgatatatacaactttgcattcacttgggcaagggaaaagggtcaaaagtctctctcactggagacttctattggaatgtggcagttgctatttgctgaaaggaactggcctcttctggatcattggtgtcagtttttacaggtcagacacaataaagccatatctagagacacatggtcccagctgctggaatttgtgaagacgaccgatccacagttatccaactacgacgacgaaggtgcctggccctacctcatagacgaatttgtggaatatctgactgagaacggactcgtccagcgtaaaagatgaacaacggggagatgcatctccaaacaatggttgggctgtacaaacatgatttatctcggtcagctcgacgcccagggcctgatattggcactcctgctcaattcattcaccaaactgttggcatatcattgaatttgcttataaacgtggggaaacataacttgcctgggaagtggtggctgtcagcctgcgatcgtgaactgtaacttatcgaaaatgcaacggagtttgggactctactatatgatttgtttcagtttttctt

SEQ ID NO: 2404 - DNA, 1468 bp, Zea mays
  misc_feature: Ceres CLONE ID no. 298172
  misc_feature: Encodes the peptide sequence at SEQ ID NO. 1687
ccgggtachgagctcgaattcgtaatcatggtcatagctgtttcmwgkggatcccccgggctgcaggaattcgcacgagaccattacctagarcatcctaatcgaraagcaggttccagtattccaccacgcggcgtcgcctgccgaaccccgaaccttctcgaggtcgaggcccctcccctttcgccaggaggtgcgcacggcacgactaacctccacactccccactagcttttcttcccagtttgctccgattttgattccatgaaaacaatgagcaggcgcaacagccgtaccatctatgtaggcaatctccctggggacatccgtgagagggaggttgaggatctcttctacaagtatggccgtattttggatattgacttgaaaatacctccgagacctcctggatacgcattcgttgagtttgaggatccacgtgatgctgatgatgcaatttatggccgtgatgggtataactttgatggctacaggttgagggttgaattagctcatggtggcagaggccagtcttattcttatgatcgttcaagcagctatagcagtgcatgccgtggaggtgtttctaggcgctctgatttccgtgttatggtcactggtttaccctcatcggcatcgtggcaagatctgaaggaccacatgcggcgcgctggtgatgtctgtttctctgatgtataccgtgaggctggagaaactattggaattgtggattatacaaattatgacgatatgaaatacgcgattaggaagcttgatgactcacagttcaggaatgcattttcaagagcatatatcagggtgagggagtatgatgctagatcacgaagcagaagccgtagccactcgtactctagaacccccagctacagcaggagcaggagtccaaaatctgtttctcagtcaccctcatctgtggatgaaagatcgctatcaagatctcgatccccaatttcttctccttctcatgcaagatatgcgacaagccctaggagcagaagcgcatcccgttctcggtctcctgttagatccgattgaactttgagagcccttgaagcagtgagcagccccagggagaagaaaggaacttgagagtatgccgtgccatcacaatggtccgagtgattatgctgttgccactgctccctcacatttaagaggtttcctcttatttagacggcgcatttaattaacattatcttgctaaagagagacttatgcgtagtctacttgtgtactcgttcgtttgtcctcatgttcttggcttcaggaactctggttttttatcattgtacccatagtaaaacctagatgtagttggggtatgccgtatgcgtctatattcggttggtcgaatgtaaatctggatgcatatatgcatctgtttggtttcatttaggcctttccttggtttcgtgattaatgacaacataagcttattgctgtgagc

SEQ ID NO: 2405 - DNA, 697 bp, Zea mays
  misc_feature: Ceres CLONE ID no. 305612
  misc_feature: Encodes the peptide sequence at SEQ ID NO. 423
gcaaagaggaatacgattcagcttagctcagctccaccaccaccaagaacaagatctcgacgaagcagccagacgacaggcaggtagcaccggggtcaacgcggcagacaaacaggctctcccgctcgtcagctagcagccatgagtaccatgaagttttgccgtgaatgcaacaacatcctgtaccccaaggaggaccgggagcagaaggtgctcctctacgcctgccggaactgcgaccaccaggaggtcgcggacaacaactgcgtgtaccggaacgtggtgcaccacagcgccggggagttcacccaggtgctccaggacgtggccggcgaccccacgctgccccgcaccaagtccgtgcgctgctcctcctgcggccacggcgaggccgtcttcttccaggccactgcgagaggggaggaagggatgacgctcttcttcgtctgctgcaacccgagctgcggcaaccgttggagagaataatggacggttcctctggcgcaacagccaggacgacatgattttttttgcaagattttcatccgacagacctgctgctcccccccatatgagcatgtcaactgattggattggattggattggattgtactactatgttcccagtgcgttcagacatttcaataacttgccggcagggtaaacttccctgtggcctgtgcttcattcatttgt

SEQ ID NO: 2406 - DNA, 1023 bp, Zea mays
  misc_feature: Ceres CLONE ID no. 324760
  misc_feature: Encodes the peptide sequence at SEQ ID NO. 579
gttttgacgtgtgttcgatcttccggatgcgccggcccactgcaggaatggcggcgaccggaggagcgatggggagctacacgcaggcgggcagcgacgccgcgctgggccccggccacggccacggccacgcgcagctcagctcgcagtggagcttctccaggcaggacctgccgcagatctcggagatggggatgataccggccgacatcggggagagcatcgtgggcgccggcgggtgcaacagctccagcgacgccgcgcagtcctcctcctacctctccaggaccttctccgtcggctcctgggacgacaccaactccatcatgttctcgtccgcccccagcaagaagcccaaggtggaccccgccgacgacatggtcgccagcttcagcaccattgacccgcagttcggcctttccaactcgtccctggagctgcccggcatggacgactacctgcagctgcagcaggactccgtcgcctgcagagtgcgtgcgaagcgtggctgcgcgactcaccctcggagcattgccgagagggaaagaaggacgaggatcagcaagaggctgaagaagctgcaagacctcgtgcccaacatggacaagcaaacgaatacgtcggacatgttggaccttgctgtggattacatcaaagagctcaaggaccaagtcgagaagctaaaacacgaccaagcaaactgttgttgcctaggcaacaagagctgctgctgatgctggagaagcagacggaggagggtttttacgccgtaacaatgtaacatgtggagcggcttccatgactcagcttcstcttttcttggttgttccacggactagcgacccggccggtgccaacggcttgaagactaggagataacaagtaggacgatgttgtaatttagctaccacgacgcggtggctctggcttgcgtgtaaagaagtcctccctttcaacgcgactgggattgttgttgctggtaaaattgttgtaggaatatcatctgcgctccatttttcatcc

SEQ ID NO: 2407 - DNA, 840 bp, Zea mays
  misc_feature: Ceres CLONE ID no. 327449
  misc_feature: Encodes the peptide sequence at SEQ ID NO. 2054
agaaagcagtccagcctgcctctgcctgtttcgtgtgtctgaggatctcctgatctccttcctccctgtccttctcctcccctccccggctacggaggtgctggtgggtgctacggaggagtactacgacgacgacggcgaggaggagcctgtctttttgtttgtggacaagtgaacccacatcctcctcaccgcccatcgcagactctgcgcggctgctgacaaagagtgcagaattgccaaagactagtacgccgacgacgaccagcagcagctgtccgggttccatggagggcggcgacggcgagacgacgctgtccgggttcggcgtcggcggcgtggacaccaaggtgctgcacgcgttccagaccagcttcgtgcaggtgcagacgctgctggaccagaaccgcctcctgatcagcgagatcaaccacaaccacgagtccaaggtgcccggcgacctctcccgcaacgtcggcctcatcagggagctcaacaacaacatccgccgcgtcgtcgacctctacgccgacctctcctcgctcttcgccgcatccgacggcgcgtccgagggcgggtccgtcggcaccgtccgccaggcgggcgccgccggacacaagaggatcaggtccggcctcgactgacctgtttaattaggcagcttccagatcaaccaaccccttcgtcttgtcttagcttagtacctgtaccagtacagtagctatatcatgccagtagtgccaccaccagccagggacctcccttttcatttttgacttgagctcatcttctcaattgcatctgtccacgacgtacgctatatatatatctatccatact

SEQ ID NO: 2408 - DNA, 1420 bp, Zea mays
  misc_feature: Ceres CLONE ID no. 331400
  misc_feature: Encodes the peptide sequence at SEQ ID NO. 1961
acaacacttcccgcaacagaagcatacgccgtgcccatctatctatagctagcactagcagtggtgcacactgaaatggacagcgccagcagcctcgtggacgacaccagcagcggtggcggcggcggcggcggcgcgtccacggacaagctaagggctttggccgtcttcgccgccgcctcggggacgccgctggagcgcatgggcagcggcgccagcgcggtcgtggacgcggccgagccgggcgccgaggcggactccggctccggtgccgccgcggtgagcgttggcgggaagctgccgtcgtccaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacatacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgcgcgggagcacctcttcgacaagacggtcacccccagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgcaggcgccgacaccaagctcttcatcgactgcaagctgcggcccaacagcgtcgtcgccgcctcgacggcaggcccgtcgcctcgggcgccggtggcgaaggccgtgcgtctcttcggcgtcgacctgctgacggcaccggccaccgccgccgcggcgccggcggaggccgtggctgtggccgggtgcaagagagccagggacttgggttcgcccccgcaggcggcgttcaagaagcagctcgtggagctggcactagtgtagattaatgctacggagcgatcgatctttccctagctagctagtcttttttattttttttgctcgatcgctcaactcagatggtagcatcaccgagctgaatttagttccctctcggcatctcacttagttggttcgtttgttaatttccagtttcacc

SEQ ID NO: 2409 - DNA, 869 bp, Zea mays
  misc_feature: Ceres CLONE ID no. 342112
  misc_feature: Encodes the peptide sequence at SEQ ID NO. 429
aacttttcgctactccatcgagggcagagccgccgccgtttcttcaatctcgcagcgccggcgcttcatcttccctcccttttttactcgcgatcggcacgcaggcggcggctgcggcgctcaggctcgggctctgcgactgcgtcagcggcttcccctccggcctctcgccagtcaccgcgcgccctcggccccggtcctctgcacaccggccggtgaccctgcgtgcttgcctttctcctcccgcctccggtggatcgtcaacggcgcccggccccggcggcagcgctgcgcgcgtctcgagggcagcgggagccagcagccgctgctccaccaaggcggaagcattttggaaccctgaactctgggctttaagaagacactactgctgcaaccatgagcaccatgaagttttgtcgcgagtgcaacaacattctgtaccccaaggaggacagggacaggcgcaccctgttctttgcatgtcgcaactgcgagcatcaggaggtctctgacaataactgtgtctatcggaacgaggtgcaccatactgctggggagcgaacacaggtcttgcaggatgtagcttctgatccaactcttcccagaaccaagactgtccgctgcaatctctgtgggcatggagaggctgttttcttccaggccgcagcaagaggggaggaggggatgaccctgttctttgtgtgctgcagccctgattgtggtcatcggtggagggaatgatgcgatgaaatcttcgctctaatagttgtttcatcagagcatgaaacttaacttgttttgtagttttcttggactatgtatttcgaatctgacctaagattaatgagagaatgtctttccaatatttt

SEQ ID NO: 2410 - DNA, 1235 bp, Zea mays
  misc_feature: Ceres CLONE ID no. 354956
  misc_feature: Encodes the peptide sequence at SEQ ID NO. 2009
gtcgctcggcttcagctcgcccacgacgagaacgagacaaccccccgcatttcaaagcgtccttgggccgtgagcgtgaggaggcgccatggccagcgccggcgggcggcggcggtccaaggcgaagccgcgggcgagggccgggggcaaggcgaagaagaggaccaagtaccttagcctcaccgagctgctggttaaggcgcacgcgcaggtgggagcgtcgccacggtccccgtgggaggacgaggaggcggtggcggcggaagtgaagccggaggacgacgcctgcggtgacgacgacgacgaccaccaccaccaccaccacgaggcgtccaccctgttcgaggccgtgccggcgccgtcgctctccgacatcctgggcccgtcgccgcccgagtcgccggccggctccggctccggggcgctgccgggcgccgaggaggaggacctcccgcgccgcgcgctgcggggcagggccagggagcgctgggtgtactgcaccggcgggccttcgccgccaccgccagcgacggcaaccggcaccgccaccgccaccgcgtcgccgtgctcgtccgccgcgagcacgggcgcgtcgccgcgctcgctgctgctcaagctggactacgacgagatcctcgcggcgtgggcgggctgcgggccgctctacatcggcgccgccgtcagcccgcgtccggtcctcgcggacgctgaggtggctgtaggaagggcggagagggtgaggcggtacagggmgaagcggcggcggcggcggctcttcttcgcgaggcgggtccggtacgaggttcgccggctcaacgccgtcaagcggccgcggttcaagggccgtttcattaaggaagaggaaagggagctccggcctgcgcctgcatagcctcctgccctgccctccttctcctttgcttcttccacggctgaagcattcattgagctgtctgtctgtctgtctgtctgatgtatgcttcccaaatctactgcatatcacacacagtcatagactgacagaccacaagtccacaacatgtgacccgttcctagtcagataggcccacctgtcagccaacgttctatgtagagtttgtcttgttccttgcgcctgccacagtgccacctgggtggacgagagcgggaggcgggagcagtgtcggcgacgccgatggctcggaaatcctttggcaataaaaaagaaaaagaactgagggaataactacgaagtt

SEQ ID NO: 2411 - DNA, 518 bp, Zea mays
  misc_feature: Ceres CLONE ID no. 380874
  misc_feature: Encodes the peptide sequence at SEQ ID NO. 1227
gttgacaaccaaacagatacgcgtgtaggcctatcaatattcatatcatatcgtacgactttcttttctgaaaaaggagcttgcgamcgtcggttgcacgttggagcttcagacgaggagcgcacacccacatctcctggtcccgtcccacctgcaccgcaacctaccggcacgccaccattcccacgggctcacgtagaccgggcccagcctccccccaccaacccttgcctccccacacctcagcatcaaccactcgtctctttttctccgccccgcccgaagccgaggaggagaggggagcagcgagatcgtgcgcgcctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgtt

SEQ ID NO: 2412 - DNA, 1574 bp, Zea mays
  misc_feature: Ceres CLONE ID no. 383227
  misc_feature: Encodes the peptide sequence at SEQ ID NO. 804
aaaaaccaagaaacagctgaggcggagaggtagctacctgagccaatcggtgtcgcaatggctgcagcgggtatcaccagggcgccgccgatcgggcagaatccgaggctcgcgtgctacgccccgaggaggggcggaggcgtggtgaggtgctcgttgcagggcgcggtcgtcggcggccgggcggagtggcagagcagctgcgccgtgctgtccagcaaggtggccgcgctcggtacgcactccgtcaacggccacgtcgcgccggcgccgactcagaacggggcggtgctggatttggtccccgtgagtagtagtagtatcaatggcgccatcaccaagaacctgccgcagccgcttcgcatcgcggacctgtccccggcaccgatgcacgggtcgcagctgcgcgtggcctaccagggcgtgcccggcgcgtacagcgagaaggcggccgggaaaggcgtacccgggctgcgacgccatcccctgcgaccagttcgaggtggcgttccaggccgtggagctgtggatcgcggaccgcgccgtgctccccgtggagaactcgctgggcggcagcatccaccgcaactacgacctgctgctccggcaccggctccacatcgtcggggaggtgcagctccccgtgcaccactgcctgctggcgctgcccggggtgcgcaaggagtgcctgacccgcgtgatcagccacccgcaggcgctggcgcagtgcgagcacacgctcacggccatgggcctcaacgtcgtccgcgaggccttcgacgacacggccggcgccgccgagtacgtggccgccaacggcctccgcgacacggccgccatcgcgtcctcccgcgccgccgagctgtacgggatggaggtgctcgcggacggcatccaggacgactccggcaacgtcacccgcttcgtgatgctggcccgggagcccgtcgtgccgcgcaccgaccgccccttcaagaccagcatcgtgttcgcgcacgacagggagggcacctccgtgctcttcaaggtgctctccgccttcgccttccgcgacatctcgctcaccaagatcgagagcaggccgcaccgccaccgccccatccgcctsgtcgacgacgccaacgtcggcaccgccaagcacttcgagtacatgttctacgtcgacttccaggcgtccctcgcagagccccgcgcgcagaacgcgctggccgaggtccaggagtacacgtccttcctccgggtgctcgggagctaccccatggacatgacccccatgaccgccggctcctcctccaccgttgtttcctcgtccgatgatccctcgtcgtcttgattgccgttggaggctggagctagctccgaggagaagtcgtcgagtagggacgttggttttctgctcatgtcgtcctactcgatcgcccctcgctgcagccggagtagttaattttgagtttcctttaatctttcatggtaatagtattatgtacgtgtaattgttcaaaatcatccgcggtgaatatatctgtgaaacagtactacatgacattcataatttcatattaatcagttttcag

SEQ ID NO: 2413 - DNA, 1004 bp, Zea mays
  misc_feature: Ceres CLONE ID no. 398632
  misc_feature: Encodes the peptide sequence at SEQ ID NO. 502
acagtctactggccttgtggtgccggcaactgactaggatcgagaaatagggttcttggagagcggccggtccatggcacagcggggcgagctggggcggcagctcccgctgagaggccccctcaaagccctagaggcagacatccaccacgctaacgccatggcagatgctattcagaggaattatggtggcgcatgtgtgcagatgaggctgtcgttcagctccctggctccattgtttttgtacttcatccaatggctggactgcggctgctgttatgcccttcccagctatttaggattgtttcacattctcatatgcaaggtttatgctgatggagatagctcagtgtcgacatatgaaaggcgggcaagccttagggaattctacgcaattatctatccgattctgcagcagcttgagagtagtttgatcgagagggacctgaaagggaagggccgatgcaaggatatagtgagtaggaggaggatggaggattggaaaaaggtttccggtagggatgtggaaagggaggatgaatgcgggatttgcatggaggcatgcaccaagatggtcctgcctaattgcagtcatgcaatgtgcataaagtgctatagggactggtataagagatcagagtcttgccctttctgccgaggaagcctcaaaagaatccgctcgacagacctttgggtgcttacaaattccaacgatgtcatcgaccctgcacatttagaaaaggaaaacgtgaggcatttctatagctacattgacagcttgcccctaatacttcctgatagcattttctttttctattacgagtatctactataacgctgaggcaacatacatcagatgtgtaaattgcgaaaagcagatgaaatcatggttttcttttgtagatgaacccccctctcactctgaccacatgcatgtctatttactcataggctgctaatgtaaacattaatgcatctgtcaataaagttgttaggagatattt

SEQ ID NO: 2414 - DNA, 465 bp, Zea mays
  misc_feature: Ceres CLONE ID no. 416460
  misc_feature: Encodes the peptide sequence at SEQ ID NO. 1228
  misc_feature (34)..(34): n is a, c, t, g, unknown, or other
  misc_feature (129)..(129): n is a, c, t, g, unknown, or other
  misc_feature (333)..(333): n is a, c, t, g, unknown, or other
ctattggcttctggcctcgtataaaaaatkcgangacgcgctccaccgccagaatcatcgtcaccccggagcctctccttcccggtctcctccgcccgttgccttcgtcccctccatctccggctgcgngccggcgagcccgacaccgcgaatcggatccgccgacaaggtgakaggkaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggnttcaatgttgaaactgcggagtacaagaacatcagcttcactgtctgggatgtcgggggccaggacaakatcatgccactgtggaggcattacttccagaacacgcarggtctcatctttgttgtggacagc

SEQ ID NO: 2415 - DNA, 1806 bp, Zea mays
  misc_feature: Ceres CLONE ID no. 458156
  misc_feature: Encodes the peptide sequence at SEQ ID NO. 1730
aaaaccccaaaaagaaatatccaaggccgcgccgtgcgcgcaatccccctcgctcgcaccatggcgctgcagctccagctgccgcggccgctcgccgccgcacggccctctatcctcctcccttccccagcccatggtgcctccgcttccgcgaccccccttcacgcccgcgcaggcggcgttgcgttttcgctccagaccaacgtgcgcctcctcaagcccaaccgccgcgtccgccgctctcgggacccctactacgatctcgacgaggacgacgaggaggaggcggagttcgacgaggacgatgaagacgacgaggagggctacgagagcgatgatgacttgtcgggtttggaatatcctggtgtactttattcaaacagccctcgtgcttcaagcaagaaaccaggactccaaactccaatggtaaaagaaaactgggaaggaagacaaaccaaaacccatgacaaatacggtagtccaggaagaagtaagtccatgcatcctaggagtaaagtgggacgatcatcaacagatcttaagaacatggacagagaagttgagttgaaaaatgcaagtatctctcgaagtctgttccagaaactacaagaagaatatgacttcgatgacaaatggttaccactgattgattacttgtgcacctttggactaaaagagtctcattttacttacatctatgagagacacatggcctgctttcaaatcagtcaggcttcagcagaagaaaggttggatttcctgctaaatgctggggttaaaagcaaagatatgaaaaggatactggtgaggcagccacagattctggaatacacccttggcaatctgaaatctcatgttgattttctcgtgagcattggagttccaaatagacgaatagggcaaattatttctgctgctccttcgatgttctcttacagtgtggagcagtctctgaagccaacagtaaggtatctgattgaggaagtaggtattgaggagagtgatgtggggaaagtagtgcagctaagcccacagattctggtgcagaaaattgatagtgcatggaaatctcgatcgcttttcctgtcaaaagaactggatgctcccaaacatagcattgttaagatggtcacaaaacaccctcagctgcttcactacagcattgaagatggaatcttacctcgactaaatttcctgagaagcattggtatgagaaactctgacattctcaaagtattgacaagtcttactcaggtgttatctttgtcattggaggacaatctcaagccaaagtatctttacttggtcaatgacctcaagaatgaggtccaatccttaacgaaatatcctatgtacctgagtttgtctcttgatcaaagaatccgtccccgccatcgttttctggtttccttgaagaaagctccaaagggcccatttcctctgagctcctttgtgcccacagatgagcgtttttgccagaggtgggctgggactagcttggaggcataccatacattcagacagaggttgctgctaacaagtttcacagagaagtctggaaggaaaacactagtctcaagacggtagatgcctaggtggtgggagtttgtttctcttgagcccacgctcctaacagtaagatgatctctttctgattttagagtttgtttggtagcagtctgcatacgcatagtactgattagtgattagttcacagttctcaggaaatgggcttggttgctgacttggtacttgatgttcacagggtttatactgcatcattaactatagcatatacttatcgcc

SEQ ID NO: 2416 - DNA, 1428 bp, Glycine max
  misc_feature: Ceres CLONE ID no. 463157
  misc_feature: Encodes the peptide sequence at SEQ ID NO. 1088
aactcactcactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttatg

SEQ ID NO: 2417 - DNA, 1326 bp, Glycine max
  misc_feature: Ceres CLONE ID no. 463184
  misc_feature: Encodes the peptide sequence at SEQ ID NO. 368
aagagccactcacatcatcacatgtacaatgacagccaaataacagtcacatgatgactcattacaccctaaccaacgaacgacctccctcaacaataattcttctgatccgtttcgttcaaatcaaaataaaaaatcgcctctttggaacgctgcctccttctgacaaaaaacattgtaccatccgaaatgtcggccatggtggaacatacggatcaaagagctgaagctattccccaatccacagctgcaccaaattggactattcatgtgtcagacataaaaacagttaaggttagcaacatatcattggttactttcaagaaggacattgaagaattcttttcattctcaggtgatattcgatatattgagatgcaaagggaaagtggtcacactcaggttgcttatgttacattcaaggatacacagggagcagacacggcagttctcttaacgggttccaagataggtgatctatatgtcaccatcacacctgtggagaagtatcagctgccccctgaagcacttccctcaagtccaacaaaccaaagccctgatgcagttaagaaggctgaagatgtaatgagcaccatgcttgctaagggtttcattttaggaaaggatgctatcaacaaggcaaaagcctttgatgaacatcatcaattaacctcaaatgcttcgtccacagttgcttccattgatcgtaaaataggtttaagtgataaactaagttttggaacagctgttttcaatggaaaggtgagagagatggatgaaaggtatcagctttctgaaatgacaaagtctgctatggctgctgcagagcaaaaggcaagtagtgctggatctgccatcatgagcaatccttacgtaaaaagtggagcttcatggttttctagtgcctttactgctatagcaaaggcagccgaggatgtcagcacgatgaccaaggaaaaggttgaacaggctgtggtggaaaggaacgagatcatttatggtgaaaggaaagggactgttgatgaatttgcaaagacgcacttagaggaggcttcagacattggccctgcagtagttcctgttaattcagatgatgacagaaagctggcaacaattttataactcaagttaattcagaatcccttattcccacgtacacagttggatttatttagttaacatagttattgtcagatttcagttcctgcaagtttgctgtacattgataagtcttcttgattgttatagtgatgtaaaggtttgtctgacagatgtggtgcctaaatatggtcaacattcatttcaaaaaattatttgttatttgtt

SEQ ID NO: 2418 - DNA, 1154 bp, Glycine max
  misc_feature: Ceres CLONE ID no. 463643
  misc_feature: Encodes the peptide sequence at SEQ ID NO. 122
ggacttagacacgagagtggtttttgttagtgcagaaacagagaaagatggatgaggagaatggttacagtgggagtatcagctctaacttggagactacaaaagcagagagatctgtgtggctgatgaagtgccctttggtggtggctaagtcatggcagacccatcctccttctcaacctctcgccaaggttgtgctctcccttgatcctctccaccctgaagaagacgatccctctgctgtccagtttacaatggagatggcaggcacagaagctgtgaatatgtccaaaacttattcattgaacatgtttaaagacttcgttcctatgtgtgtcttctctgagactagccaaggtggcaaggttgcaatggaagggaaagtagaacataagtttgatatgaagccccacggtgaaaacattgaagagtatggtaaattgtgccgagagaggacaaacaaatctatgattaaaaatcgacaaatacaggttatcgataatgatcggggagttctaatgaggccaatgcctggaatgattggtctagtttcatccaattccaaggacaagaagaagacacagccggtcaagcaatctgatacaaagagaacgagaagagataggggagagctggaggatataatgttcaagctatttgaaagacagcctaattgggccttgaaacagctcgttcaagagacagatcaacctgcacaattcttgaaagagattctgaacgaactttgtgtttacaataaaagaggtgccaatcaaggaacttacgagctgaagcctgagtacaagaaatctgttgaagatacgagcgccgaataagtgctatgttctttacattatactcttaactccaccgaggcacagaccctccaaaaatataggctgatggaagaaagaatcttgggacaacaaacaagaagcaaactttgtatctgaaccgtgaagaataccttgtttatgactttttttaccgataaattatcaaacatgcagttgtatacgttcaaaaggaattttagcaaccgaaaaattaatgttatgttgcctggttacgcgtagaatatctctgccactgtacatggagttgttctgttgtaaagacctacctagtaatatgatgctcttctcctagtttac

SEQ ID NO: 2419 - DNA, 526 bp, Glycine max
  misc_feature: Ceres CLONE ID no. 465010
  misc_feature: Encodes the peptide sequence at SEQ ID NO. 857
aagagctgaaaaaccctaataacaatgggaggaaaatgtccgcacaggaacgtgaagaagagaagatattctcacaagaccgcgcggcgaaccaaatttgagctgaaaggggacgacatggtttatgcgcagctcaacaaacccgatcaagagagaccccctttacccgtcgacgaagatttgcctgggatgggccagtactattgccttcactgcgatcggtactttgccaatataactgtgagggatgagcactttaagaccaaacgacacaagaagcgtataaaacaaatgatgggtcctgcaccacatactcaacttgatgccgatttagcttctgggatgggtatgccagacaatggaccaaagctaatgtctatgtaacttcttttttggtagtgggtgggacgattgtcttgggagctggtgttataaagatatatagtatttgttatttttattctttttttgttactaggtgcttgttattctattctaatataagcaatattatattttgaatgct

SEQ ID NO: 2420 - DNA, 1226 bp, Zea mays
  misc_feature: Ceres CLONE ID no. 465893
  misc_feature: Encodes the peptide sequence at SEQ ID NO. 1415
  misc_feature (955)..(955): n is a, c, t, g, unknown, or other
aggaatcgtacgtactcctacataagagaggacgcggacgcatcttcttcttccctcccggaacctgagggcaagggcgttgccgcccagccgtgccacccacgatcgggtgcgtagccatggccgtcgaagcgcatcgcctcctcttggcaggaggacacaggcagcagcaacagcagcagcagctcgccagcgcggggtggccttgggccggcgccgacgaagataggtgcgcgacgacggcgagaccgagccaacatcatcaccatcaacaacaacagccgcagcaggagttgaggctccacaacgcctcgtgcgtgggcgtcctggctccacgggtctcgacgatcgctgccggcggacagatgttcctgggcgacgcggcggagagcgacgtcacgttcggaggaggaggagctgcggcgcggcaggaggtgacggcagtggcgccggcgcccaagaggcggaagcgcgccgagcagcagcagacgccgccggtgtyccaggtctgcgcggccgacgatgtggcggcgcagtttcagcagcatatcgtcgacgtcaaccgcctcgtgttccaacaaaccgccaacatgtgggcggcgctcacggagctgcggcggcggcaggcccgccaggtcgtggccgccgtggaggcagcggcggcgacgcggctgcgcgccagggaggaggaggtccagcggacggcgcgcatcaacggcacgctcgaggagcgggccaggagcctctacgtggaggcgcagctgtggcgtgacctggcgcgggccaacgaggccacggccaacgagctccgcgccgagctgcagcaggcgctcgacgaccagcggacgcgcggcgcacctggcgccggcgccgacgccgacgacgccgggtcgtgctgccgcgggggggaggacggcgggacgggtacgtcgttggcgaggacgtgcscggtgtncggcctgagcgcggccgacgtgctgctgctcccgtgccggcacctgtgcgcgtgcgcgccgtgcgccggtgcggccagggcgtgccccgcgtgcgggtgcgccaagaacggcagcgtctgcgtcaacttttcgtgatggctggttggttgtcaaaccgataggataggattgctggattagagtagtagtagtagtagtaggtttttttgggggtcttgtttatggcagcgacggttcagtgatgcggatatgagacggatgcatcttttg

SEQ ID NO: 2421 - DNA, 609 bp, Glycine max
  misc_feature: Ceres CLONE ID no. 467336
  misc_feature: Encodes the peptide sequence at SEQ ID NO. 1177
  misc_feature (268)..(268): n is a, c, t, g, unknown, or other
  misc_feature (313)..(313): n is a, c, t, g, unknown, or other
attattcaaccatcaaccattttytctcttcttcttctctagysagaaatttctctttcattgtgtgtggtcagtgagatgtatgtagcttccatgcgcaagtctttcaaggactccttgaaagtccttgaagctgatatccaacacgccaataccctggcctcagattttccaagggagtatgatggtgcatgccttcagatgagaatgtcatacagtccagctgcacacctgttccttttcttggtacagtggacagattgccatncttgctggagcccttggactgttaagaatcctaatttacaaggtnctatgtggatgggacaaccaccatgtctacacatgaacgaaaagcaagtattagagaattgtatgcgggcatttatccctctttgccgcaacttgaaaaaggtgtaactgatactgaggataagaagcaaaaggctgttgtgcatgggagaggtacccgtamaaasagatkratgagggagtatagggcagdtcttctgrcaatagacatttgaaagarraagatgaatgtggaatatgcatgggamatgaawarkwaagattgtgcttyccmaactgvaatcatgccatktgcct

SEQ ID NO: 2422 - DNA, 918 bp, Glycine max
  misc_feature: Ceres CLONE ID no. 471377
  misc_feature: Encodes the peptide sequence at SEQ ID NO. 1985
gactaggacacaagacgataacaaatggcatcatctcagtcgaggaagagagttgacgccgtcgattctcgcgctgcttccgttctcgttcgcgccaaagatggcagtgcttttgctcgttgcgacgattgcaagaagaatgtgccggttgcactcatcgacatgcacagttgcagccttgaagctaaaattaaaatgaacctagacgctcaagttgtggaacaggctgctgaagctaagaagccggagaggaagaagcccaaatctaaagagcctatggcaaaaaaagctaaagttgggaaggggaagaaagtcaaggatcctaacatgcctaagcgtcctcccacagctttctttgtcttcttggatgattttagaaaatctttcaaagaagctaatcctgattctaaggatgttaaaagggttggtaaagaggctggtgaaaagtggaggtctatgactgatgaagagaagaagccatatcttgacaaagttgctgagcttaaggaagagtacgagaaggctatggaaagctatgaagctggtcaagatgaagaagatcaaactgtgtctgataaggaaacttctgataaggaagctgctgcaaaagaagttgcaatagaagttgaagaggagctaactgacgaggactaatggttgcattatggcactccttgaacttgatagctattattctaagggccacataattacttaacgactagggttgtaaattttggaacatgttttagttggagttaaaaactgttgaaatccatgcgcaatatcttttcattttttgtaatgctctcttgtgatgttcgtgaatggtagtcacattgttttctacaagaggcttgttggtctcttttaggattgattattgcttgcatatgtttgagcctttgaggcaattgg

SEQ ID NO: 2423 - DNA, 1225 bp, Glycine max
  misc_feature: Ceres CLONE ID no. 473509
  misc_feature: Encodes the peptide sequence at SEQ ID NO. 137
gccttcgttttcaggtttcttcttttggtcatctaggaattttgtgtttatgttcaaaattgctagatcgtgtgttggggttggggtggtgttctgtggacatgtcagatattaaagaagaaaccaacagagtttccattctcggtatctcttctctgatcaggttgacaacttgacatagcaatcctgctttcttggttccccatttccatgtttgtggattcttcctgattcaaaggcaatccattgtgtcttcttagctcagttttgagcttcaaaagttacaacttgcaacacaaatttttatctgtaactttggtaatcctaaaggactcagcattgatcaaaatgggcctttcaagtctcccagcaccatctgaaggagtattatgtgtccttctggtgaacactgtattgtcaatttcaatattcaaaggcattgttaggacaatcctacacattgttggcatccatctttcatcatcatcctccacttcaccctcttcaccggatccctcgctaaccgcacctgagtcatttgaattccatcttagtccctctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttccctttttctgtctgtgctctttagcacacatgaggggtatactttttgcttgcatgttatgtttgttcacaatgcccacctggtttagacctccttaaattctatatttgggcattttgatcctaatttggaagcatggattgtagaatccatttgttttgcctttcaaactctcatcaccatgtgtatatatagtgtatgtgtgtaaatagctgtggtcggcaataaaattcagtcatcactaaacg

SEQ ID NO: 2424 - DNA, 942 bp, Glycine max
  misc_feature: Ceres CLONE ID no. 474230
  misc_feature: Encodes the peptide sequence at SEQ ID NO. 875
gatttcacaagcaaaaaaatcagagaacatagaagaaaaaagagggctaaaaaaagagagtttgagaaatggggaggggtaagattgagatcaagaggatcgagaactcaagcaacaggcaagttacctactcaaagagaaagaatgggatccttaagaaagctaaggaaatcactgttctatgtgatgctcaagtttctcttatcatctttgctgcatctggaaagatgcatgactacatcagcccttctaccacgttgatagacatattggagaggtaccagaagacctcagggaagaggatttgggacgccaagcatgagaacctaaacggcgaaattgagagactcaagaaagagaatgacagcatgcaaattgagctcaggcacttgaagggagaggatattaactctcttaactacaaggagctgatggccttggaggatgccttagaaactggtctagtcagtgtccgagagaaacagatggatgtctacaggatgttcaggagaaacgacaagatcttggaggaggagaacagggaacttacttttctctggcaacaacgtttggcagtggaaggtgcgagaraagtggacaacgggtttgatcagagcgtaagggattacaattcccatatgccatttgcctttcgtgtgcagcctatgcagccaaatcttcaagaaaggatctaagtaataaagctcttgtattcaaaaactccatcttggtgttttcagaaacctatgtgtcacaactctttaagtatgctggtatctgcaaaagttgtaagtaataaatttataagcaactgaacttggctttgtgaagttacaacatatctgtgtgtctcatatatacctttgttgggtgatatgacatcttattgtgtgtcttgtagctatatatgcacgcaaattactctgattcagctacttatct

SEQ ID NO: 2425 - DNA, 1201 bp, Glycine max
  misc_feature: Ceres CLONE ID no. 474481
  misc_feature: Encodes the peptide sequence at SEQ ID NO. 1956
ttatttttcttctgaaaccctaaattttgtctgctctaaactttgggatctttcacacttgaaaaaaactgcttcttgtgcccgacccagcacaattctcatactatagatctttgaatcaaatataatttctgatcattttttttgtttctctttttcccccatttgatcccttctcaggttctggattctcagtgtttgcggagcgcagcatcatcttttagggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctacaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcatctccagaacattagctgatgtgtcgtggaaattaagataaccaggcactggaatcagttgtgaatgtcaaactgaatggttgggaaggtcgatactacatagcgagcagaagctgtagctgatagtttacatgcaatgcagactataaacatatgtagataatgtgctagggaaaacttaaccttatctttgatttagctgg

SEQ ID NO: 2426 - DNA, 1522 bp, Glycine max
  misc_feature: Ceres CLONE ID no. 474693
  misc_feature: Encodes the peptide sequence at SEQ ID NO. 576
ttttttcaatggagtcagatcttcagcagcaccctcccatgtttttggatcaccaccagcagcagatgaattcagggttgacacgttaccgatcggcgccaagttcgtatttttcgagcatcattgaccatgagttctacgagcacgttttcaatcgaccctctagccccgaaacagagcgaatgttgacacgctttgtgaatagtcttggtgggggtgatgctgatgcagaggattcacttgctactactcagaatcccccaactgttgttgcggttaaggaagaggttaatcagcaacctccggatgttacatccatgaataatgaaccacttgttctccaacaacaacagcagcagcaacaacaacaacaacaaagtaataatatgtataattatggctcttctggtactcagaatttttaccaaagcactggacgaccacctttgccaaaccagatgaagactggtcatggaagtagttctaatcttatcagacatggtagctcacctgctggattgttttcaaacattaacattgatattactggctatgctgctgttgtaaggggcatgggaactatgggagctgctgctaataacaccagcgaggaagcaaacttttcaccagcaacaaggatgaagaataatgcaccaaacttctcttcaggactaatgtcatcaagggctgaagttggaaacaagagcaatacacagaacaataatgcagaaaatgaagggtttgctgaaagccagggcaatgagtttatccctgcaggtttccccgttggtccgtggaatgattctgcaatcatgtctgacaacgtgacaggtctgaagagatttagagatgaagatgtgaaaccattttctggtggtttaaatgcacctgaaagtcagaatgaaactggaggccaacaaccttcttctgctttggctcatcaattgagtttgccaaatacttctgcagaaatggcagccattgagaagtttctgcagctctcagattctgttccttgcaaaattcgtgccaaacggggctgtgccactcacccaagaagcattgcagagagggttagaagaactaaaattagtgagcgaatgaggaagctacaagatctcgttcccaacatggataagcaaacaaacacagctgacatgttggacttggctgttgagtacattaaagaccttcaaaaccaagttcagactctttcggacaatcgggcaaagtgtacgtgttcacacaagaagcagcaataacgcaaaaggaggaggatacccgcgtcattacgtgtacagcttagtaataatttggtctagaaactagtgcacctttccgataattatgtagccacatcttcagcggttgtttgggagtggttgtgggaaaatcagcttataaaagttgactttatatatcatcaaaatcaaaatttgatgccacatattcaaagcatggtgtacaaaattttctgatatattacaagtctatttgcctttagaaaaaaaaaaaaaaaaaa

SEQ ID NO: 2427 - DNA, 2054 bp, Glycine max
  misc_feature: Ceres CLONE ID no. 475016
  misc_feature: Encodes the peptide sequence at SEQ ID NO. 1976
gatatgcctatgcctaagttttttcacaattggaatagccttgtcttctacactcccccaagctcttagattctaatccactgtggttttccaacctcagaatttcctcaaaacttgacagcagattatgtgaaaccagaagagagaaccttgagaagtcaggactatatctgtttccttggcatcagtatcaattaacagctttctctaggctactattgtccattgttgtgcttctacatataatctgttggaagagatcagttgaagtactacaacacagttgagtcccggcaattctataatgcaggcatcagagcaacatagaaattcaagtatgtactatcaaccattacaacaaattgaagcgtactgcttgccgcagtatcggacactaaatccgcagctatactaccatgatggaggccatggaactcagttttcaactccaagttcttcagaactttactgcactttggagtcatcttctgtagctctttacaactccccttcaactgttagtttctcacccaatggtagccccatatcgcagcaagactctcagtcatatccacctgaccagtatcattcccctgagaatacctatggctctcctatgagtggctcctgcataactgatgatttaagcagcttcaacttaaagcacaagctgagagagttggaaagtgtaatgcttggccctgactctgataatcttgatagttatgacagtgccatcagcaatggaaacaactttgttccactagagatggacggttggaaacaaacaatggtggcaatttctagcaaaaacctaaagcatatccttattgcatgtgccaaagccatttcagacgatgatttgctaatggcacagtggctgatggatgaattaagacagatggtgtcagtttctggcgatccgtttcagcggttgggagcatacatgttggaaggacttgttgcgcgattggctgcctctgggagttcaatatacaaatctttaagatgcaaagaaccagaaagtgctgagcttctctcctacatgcacatactgtatgaggtttgcccctacttcaaatttgggtacatgtctgcaaatggagccattgcggaagcaatgaaagatgaagacagagttcacataattgatttccaaattggtcaaggaagtcagtggatcactttaattcaggcttttgcagctagacctggagggccaccccacatccggattactggtattgatgattcaacatcagcatatgcccgcggtggcggactacacatagtgggaaggaggttatcaaagcttgctgagcattttaaggtgccatttgaatttcatgctgcagctatctcaggttgtgatgttcaactacataaccttggagtacgaccaggggaagctctggctgtaaactttgcgttcatgctacatcacatgccggatgaaagtgtgagtactcagaatcacagggataggctgttgaggttggttaggagcctatcaccaaaggtggtcacacttgttgagcaagaatctaacaccaacactgctgcattctttccacgtttccttgaaactctggactattacacagcaatgtttgagtcaatagatgtgactctttccagagagcataaagagagaatcaatgttgagcaacattgtttggcaagagacttggttaacatcatagcttgtgaaggggtcgagagggtggaacgacatgaggtgctcggcaagtggaggtcaagatttgcaatggccggtttcactccttaccctttaagttcattggtgaatggtaccatcaagaagttgctcgagaactacagtgatagatatagacttcaagagagagatggagctctttatctgggttggatgaatagagatttggttgcttcttgcgcttggaaatgaaagttctgcaataaggcataacatccctcttctttttctgttccattactatgtacaagttaatgacaaaggtctcaacattaaatccaatctaattgtccattttctgtgtttcaagaatttc

SEQ ID NO: 2428 - DNA, 1050 bp, Glycine max
  misc_feature: Ceres CLONE ID no. 476445
  misc_feature: Encodes the peptide sequence at SEQ ID NO. 2053
atatcatctgtcctctttcttctctctggatttttctccatcatttcagggctttctttcttctcttttgcctcccatattccattctcctcaaaatatctctacattttcctctctaccccaacaaaattccaaaaatttcccctcctatctccttttcacgtcacttaccacaactgggatgctccactttcttaaggattatttgttaactgagtcctaagtgtaattgagatggacggtgatatatttggagaattaggcaattcaactcaagtagatagcaggcttctacaggtatttcaaaagagcttattgcaagctcaagatattttgaatcagaatcggttgctgatcaatgagataaaccaaaaccatgagtccaagatgcctgataatctgagtagaaatgtgggtttgattagagagctcaatagcaatatcagaagggtggttgatctctatgctgatctctctaattcctttaccaagtccagagaagcttcttctgaaggtgactcctctgggactctgaagtctgatggaaaagtcaaccagaagagaattagatccagctgatttattgaatttgagctttcgggcacgcaatcaagaagtttattctgaatctggaaggaatttgtttggtgagactgtgtaacttcctccaaagttatttttgtgccaagtcttccatattggtgtttatgtttagagggccagagatttagttaatcatctgatctataaaagtagcttcaatttgaggactatacaattgtgattttgtgtaactatgtttaaattcatgaaatggagcatgttcacggaccatttagtcaagttttcaagcttgaccttcttagatccaattgatgtttggtggttaagttctagatagttattcatttgttctgcttgtttgatcatttgattggttgttgttagttgcttcccctttggttctgtatttggatatttgatgcctgagatccaataactaatttactgcttaataaatgtcatcatatattgctgaacttttattat

SEQ ID NO: 2429 - DNA, 559 bp, Glycine max
  misc_feature: Ceres CLONE ID no. 477003
  misc_feature: Encodes the peptide sequence at SEQ ID NO. 1922
tgccaagaacctgataataagactgacccgtcaacccctgaccctgaaaaggctgccaaagaccgtgctccagcgaagagtctttcaatagaatctttttcatctcaccctgaaccaatgacaccagattctggctgtcatgttggttcccctgctgaaagccctaaaggggagagatcggccaagaagcaacgagtaaccatggatggtgtgtattctaaaccagaaatggtgcttccacatcagatactggagtcaagcatgtcatcataccagcaacctaacactgtttttcttggccaagagcaatttgatccttctttggatatatctaccaaaagtgatgaggaattggttaagattggtggcggtaatctgtgatttcgtgtaatatgtaaggttgtgttctaggactgattctatcttccttctaagcttagtttgtgttatatgtattccttaatagatgagggaacctgatcttcatagattcctaaggttcttagttttcagttcaaatgttcaacacttgactaaacatccagcctttaattactat

SEQ ID NO: 2430 - DNA, 1292 bp, Glycine max
  misc_feature: Ceres CLONE ID no. 477718
  misc_feature: Encodes the peptide sequence at SEQ ID NO. 1937
gctgtcttgtccttctccttccctcagctcctcttcactccctttcattttccctcacactcatcattctcaaaaaacacgcccaaattctaatcaaattagggttagggttttcaactcccctcgaattatccctgtaatgcagtgcgattcccgggtcctaccatggagccatcagcaatgtacggaccctcccagcccctgaacatcccctcgcggatcggcgctggcgaaagagacgacggctccggcaacgagcccgccgtcgacggccaccaccaccacattcagtacgaaacgcacgcgctcgatgacggtgccgccggtggcgccgtggttgtcgaggatgttacgtcggacgcggtctatgtctccggcggtggaggccccgaggagtccagccagcttacgctgtcgtttcgtggccaagtttacgtcttcgatgccgttacgcctgataaggttcaagcggtgttgttacttttgggtggatgtgaactatcttcgggtggttcgccatgtgtggatcctggggctcaacagaatcaaaggggttcaatggaatttcctaaatgtagtctaccacaacgagctgcctcattagataggttcaggcagaagaggaaagagcgatgctttgataaaaaagtgagatatagcgtacggcaagaagttgcgctcaggatgcatcgtaacaagggtcagtttacttcatctaagaaacaagatggagctaatagttatggtactgaccaagattcaggacaggatgatagtcaatctgaaacctcatgtaaacattgtggcactagttcaaaatccaccccaatgatgcggcgagggccatctggtccaaggtcactttgcaatgcttgtgggcttttttgggcaaataggggtgctttgagagacctttctaagagaaatcaggaacactctcttccaccagttgaacaggttgatggaggtaatgacccagactgtcggactgccgctgccgaccctgcacaaaacaatcttgctgctttctcagagcctgttaatccagctttggtagctgatcgtaaggttttccaatctcagaaaatgttggagtagttgactctggcataagtaggtctatagttattccattcagattgaccaataggaatgtacagatataacaatactcccatcaatgcaagaactttgtttttatatggttggatcagtggcattaaccattgatctctggatgtatcacctgaaacttaaatgatgacttggtgatggtctcacccaataccttg

SEQ ID NO: 2431 - DNA, 1111 bp, Glycine max
  misc_feature: Ceres CLONE ID no. 477995
  misc_feature: Encodes the peptide sequence at SEQ ID NO. 511
gctgtctgtcgttctatttaattcccctctccaaatttcaacctctgtctcctctccttaacagcatcatcacatgcacccgcgattcctacgatcccttcccatggtctcttctctgcaccctcgccgtaccttctagaaccttccctcagatctcaattccccttccgctttctcctttcatggaaatggcttccactccccgcaccgtcgaagagatcttcaaggactacaccgcccgcagaaccgccatcgttcgcgctctctctcaagatgtggatgaattctacggactctgcgatccagataaggagaacttgtgcctctatggacatccgaatgaaacatgggaggtgactttgccggcagaggaagttcctccggagcttccggagcctgcactcggaatcaattttgctagggatggcatgaaccgcagggactggctttctctggttgctgtgcacagtgattcgtggttgctctctgtggccttctatcttggagctcgtcttaaccgcaacgaaaggaaacgtttatttagcttgatcaatgatcttcctactgtttttgaagttgtgactgagaggaagccagtaaaggacaagcccactgcagacagtggaagcaagtctagaggcagcaccaagagatcaagtgatgggcaagttaagagcaacccaaagtttgcagatgatggttatgaagacgaggatgatgagcacagtgaaaccctttgtgggagctgtggcggaaattacaatgcagatgaattttggattggctgcgatatatgtgagaggtggttccatgggaaatgtgtgaagatcactcctgcaaaagctgagagcataaagcaatacaaatgtccatcatgcagcttgaggcgaggcaggccctaagccgaaggcaaaatgtgaagtgaataatgctgtttcatggccgacaaagatactgtaatattgttgtatcttttatagaagttcttgtaaacggtatagtatctatgtctgatcataatctttcagattaagttaatttcttctaccaagattaatcatcagtgtatgttatataattttatagaatagaattctatacattttatttt

SEQ ID NO: 2432 - DNA, 712 bp, Glycine max
  misc_feature: Ceres CLONE ID no. 480916
  misc_feature: Encodes the peptide sequence at SEQ ID NO. 1447
ggctagtggtactgtctcttagctttgattctctgtcctctgttttgttctgtttcgcgtacaggaacttaaacaatgaagactgcaaagggcaagggagcagcgaggccctcaaaagaatcactgaagcctgttgatgaccgaaaggttggaaagcggaaggcttctggtaagcctgagaaaagcagagcaccaaagaaggagaagaaggccaagaaagaccccaacaagcctaaaagaccaccgagtgctttcttcgtgttccttgaggagttcaggaagacctttaaggctgagaatcctctcgtgaaggctgtatcagttgttggaaaagctggaggagagaaatggaaatccctgtccagtgctgagaaagctccatatgaagccaaggctgcaaaaaggaaagctgagtatgaaaaacttatcaaagcttatgagaaaaagcaggcaagctctgcagatgatgatgaatcagacaagtccaaatctgaagtgaatgatgaagatgatgccagtggagaggaggaccaccaagaggacgaggatgatgaggaggaagaggacgatgaagatgatgactgagattgatgtccaaaaccttggttatgatattttgtttatgagggaggctattatatattctgactgtgcatactaggctactttttatgtttgtgctggtagaaaagaatgtcttctttgttggtac

SEQ ID NO: 2433 - DNA, 1378 bp, Glycine max
  misc_feature: Ceres CLONE ID no. 480964
  misc_feature: Encodes the peptide sequence at SEQ ID NO. 902
aagtagtgtccaattctgagtgagccaaaaccaaaactcacctttcgcatccctcagctctccatcccattcggaaccaaatttcagttccacccaaaaccctaattttctttctctcccgcacctagatcttcaggttttaggcaccttccgccatgcacaaattgggaagaggtcatcgggacaaactccagcagttcataacaataactggagccagtgagaaaatagcactgcaggctctgaaggctagtgattggcatcttgaaggagcatttgatttcttttacaaccaaccccagcttaaaacatttactgattctaggcacttggaggagctatacaatagatataaagatgcatatgttgatatgattttggcagatggcatcactgtcctttgcaatgatatccaggtggatcctcaagatatagtaatgttagttctttcatggcacatgaaggctggaaccatgtgtgaattttccaagaaggagtttattgaaggtttacagtctttggggattgattctctggataagttccgtgaaaagataccatatatgcgctctgagctgaaagatgaacagaaattccgcgagatatataactttgcttttggctgggcaaaagagaagggtcaaaaatctcttgcattggatacagctattggtatgtggcaattattatttgctgagaagcagtggccacttgttgatcattggtgccagttcttgcaggctcggcataacaaagcaatatctagggacacatggtctcagcttttggagtttgcaaagactgttggctcaaatttatctgattatgatgccgaaggtgcttggccatatcttattgatgaatttgtggaatatctgaacgagaatggcatcatccaaaatggcctgatcaatgattctagtctaaaatggtgatgcattcagatctcaataaattgctctttaagagaatttgataagcctcttgtgatgagttgtgctattctgtgattgaactcctctttgttattaagtgggattcagtctaaattagattctagagcaaactcattcttgttgacaagtagttgcatcatttgtgagattgttgatatggcatatgaatttccttgggtattgtggaattagtaatgggagcctactaattccacggtgttatagtttctggtctcttttaatttaataattaattcttgaacgatgatgtcttgttagaagataagagacttatgtaattgttgttagctgtccttgtttctggtctactttcatcttgtaaaatatgtggcaccaagttattaaaacattcatgaaatagagaaggggaaaaaataactatcaaaaaaaaaaaaaaaaaa

SEQ ID NO: 2434 - DNA, 1407 bp, Glycine max
  misc_feature: Ceres CLONE ID no. 481884
  misc_feature: Encodes the peptide sequence at SEQ ID NO. 1178
tctctttctcttctctcttcactatgtgtgactctctctctcacacaaactagagcgagaaatattatagtagctctgcgtttttggggtatcattattcaaccacccattttctctcttcttcttcttccattgagaaaattctctttcatcgtgtgtgatcggtgagatgtacgtagcttccatgcgcaagtctttcaaggactccttgaaagtccttgaagctgatatccagcacgccaataccctggcttcagattttccaagggagtatgatggtgcatgccttcagatgagaatgtcatacagtccagctgcacacctgtttcttttcttggtgcaatggacagattgtcatcttgctggagcccttggactgttaagaatcctaatttacaaggtctatgtggatgggacaaccaccatgtctacacatgaaagaaaagcaagtattagagaattctatgctgtcatatatccctctttattgcaacttgaaaaaggtgtcactgataccgaggataagaagcaaaaggttgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcttgaaatgttacagagaatggcgaacgatatcacaatcatgcccattttgccgtgacagtctcaagagagtaaactcaggcgatctctgggtattcactgatagaagggatgtggtagacatggcaacagtgactagggagaatctcagaaggcttttcatgtacatagataagttgcctctgattgttcctgactccctttttgacacatacgactctcacataaggtaagtgattgcaacagaacagattttaatgtatgctgttgtcttggatggatagagctatattcctctccacttccaagttagtcacataaaagcccaagcccaaacccaatcagaggctaattgagttcgaattatatatagagtcgcagtacttgcttcccacttttgctgccagaagtatccagccctgtgttaattgtgggttggtggtgaagttgagatggtaaattgtatctatctagttagctcttttgtatatccctgtacagatcgaattaatcacttcttattaacaagagatttgcacatttggttcttgtcatttaagtgtgaatctcttgaggaaaaaaaaaatcttttacttttcatcatcaatgaatgtatttaacggaatgtaatagcctcataggtgctttttctatgtagtatctatctgtattcgctatatttcctcaaggtcctcttaatagtaactactattatgttttatattag

SEQ ID NO: 2435 - DNA, 1042 bp, Zea mays
  misc_feature: Ceres CLONE ID no. 486120
  misc_feature: Encodes the peptide sequence at SEQ ID NO. 1366
  misc_feature: Encodes the peptide sequence at SEQ ID NO. 1797
  misc_feature: Encodes the peptide sequence at SEQ ID NO. 1803
caactcagttattctacagctttaattttgcagagcgaccaccagtccaggtccagcgcgggacgcatcacatacacgcggtaccttcgttcgttctcaagcttatagcgcccgatcgaccctgcgcggagctagttcgttcgttccggcaggcggcggcagcgaagcagtgcgacgacgacgacgaggtacgtagagagcgagaggatagatgtcgagccgaaggtcgtcgtcgcacggcaacatctccgaggacgagatgaacgagctcgtctccaagctccaggccctgctccccagctcccgccgccgccgcggctccggccaggcgtcgacggcgaagctgctgaaggagacctgcagctacatcaagagcctccagcgggaggtggacgacctcagcgaccggctgtcggacctcttgtccaccatggaccacaacagccccgcggcggagatcatccgaagcatcctccgctcctgatcgcgcgcaagggcgaggtcaacgaacgccggcctccgatcgatcgccgacagcgcgcgctctccggccggctggtcacgtgcgggagctgagctcaattaggtagctagggtatatatacatataatatatatatctacatgtacgtgtatctaccttttcctttaccagtctccctagatctgagatcatgtggctagctccgtataaaaatgtactagccacacgctgacacgcacacgtatgcatgatggtctctgcgctaagcttcactgggtagtagggtatagcactagagcctaagcaagcttatcctcctcactttagtatagctcgcagcagcagcagtctctcgattcctcggcgatcttcggtggcttaattggatcgagctggctagtgcgctctctctctctctctcatctctagcaggcaggaaaagagacaaccgaccgaccactactagcctagcctagagcaaattgactgtcgttatgatgatgatgatgtactgctaaagcttttattaacgacttcaataacatgtacgtcctgcgg

SEQ ID NO: 2436 - DNA, 1305 bp, Zea mays
  misc_feature: Ceres CLONE ID no. 488960
  misc_feature: Encodes the peptide sequence at SEQ ID NO. 117
acacatctatcggtcccccgcctctatcctttctctccgcacaaggtgcccctgccgcccagccgccatgaggaagccgacccgacgacgaggaacctcagcgaaaggcagctccggcggcggtatcagtaaggcggcaacactgccggcgaagcagatggtcttgtccggctaccgtggcaccgtagacgcgtttgactgcctccccgacgacctcgtgctcgccgtgttagccggcatcgcggcgcgcgcccggtgccccgccgacctcgctgcggcggcgctaccgtgcaggaggttccgggacctcgcggcgcaccccgccgtgctgtcgcgtgcgtcggcggcggccgtcgccgtgcccgcgggaaggtggtcggatgcggcgcaccggttcttgcggcggtgcgcggcctccggcaacctccacgcctgctacctactcggcatggtgctgttctactgtatcgggggcagagcgacgggggcggcgctactggcgcgctcggcggcgggcgggcacgcggcggcgctgtacgcgctcgccgtggtgcagttcaacggcagtggcggcgacaaggcggacaaggacccccgcgcgggcgtggcgctgtgcgcgcgggccgcgtggctcggccacgtccctgcgctccgcgagctcggccactgcctccaggacggctacggcgcgcgccgcgccgccgcaaccggacgctacttcctgctccacgccgccgcacgcgagctcgtctcctcgcactgccgaaacggcgaagacgacgctgccagcaggttcatggtggagtggtgggcgctgccctccaagacaggagcacaaggcgacggcaacgacgccgacgccgacgcgcgcctgtgctcgcacccgcggtgcgggcggcgggagacgcggcggcacgagttccgtcagtgctcggcgtgcgggtccgccatctactgctcgcgcgcgtgccaggcgctccattggaagcgcgcgcaccgtagccagtgcgcggccgcagctagccggtggctcgccgccgggaacgcgcagtaaacgtacgctggccggctggtccacgcaacgccaacgttgcgcatgtacgtaacttgtgaatagtagtagtactaggtagtgccactactacatgttgccatgttggtagctagctttcatttcttgcgttaatgtaaggttaattaaactaggtgattgcatttattttgtaatttttggatcaatcagttgtttgggataaaaaaaaaaaaaaaaaaaaaaaaaaaaaaaacaaaaaaaaaaaaaaaaaa

SEQ ID NO: 2437 - DNA, 1253 bp, Zea mays
  misc_feature: Ceres CLONE ID no. 503296
  misc_feature: Encodes the peptide sequence at SEQ ID NO. 1367
  misc_feature: Encodes the peptide sequence at SEQ ID NO. 1796
  misc_feature: Encodes the peptide sequence at SEQ ID NO. 1804
aatctggatccacccccgccccgagccagctcgctataaaggcacccctctccctttctgtctccctcgcagctcagttactcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatctcaacctctctctctctctctctctcgctcgctctacatgtgtgtgtacctttctcttcctttcacctgcctgtctcctccctagatctgagatcatgtggctagctctcccatatcaaaatgtactagctacacgcgcacgtatggtggtctctgctaagcctaagcttcactgggtagtagggtactagtagcactaggggcttaagcaagctaagcttatcctcctcatcagaatcacattagctcgcaccgcactctctggcttctcgtcgatcgtcttcgtcgtcctcgctcctccgacccacatgatggctagctctccatgtgccgcttctcctctcgcacgtgccgcttctcctcttgtgttcgatatgttgtattgtttccatgtaaatttagtcggtggcctggatcgagttggctagctctctctacaggcaagagacaaccgaccgaccactactatcctagagcaaattgattatcgccaaaaaaaaaaaaaaaa

SEQ ID NO: 2438 - DNA, 1453 bp, Glycine max
  misc_feature: Ceres CLONE ID no. 511197
  misc_feature: Encodes the peptide sequence at SEQ ID NO. 1426
  misc_feature: Encodes the peptide sequence at SEQ ID NO. 1925
aacatttggactcgttccaagccggaagcaaagaaaccttatcctactcacctgtcaattagaaagccccaattcaacaatggatgtctcctcgcaatttacttgtcaagtttgaaaattgaaaccgcaaccctcattttctctcattcacccaatggctgctgtttcctcttctatctgcaacagaatatacaacctttccttcacacacccttccctttcactcaccacctgcaacttccgtcaaagacccatatcccaaaaaccattcactctcaacctcaagtcccaaagtttcactctttcctttttcccacttcaccgtcttccccctccttccgctgccttcgatgggtttgaagtagctcaagacaccacagagttccaacaagacgaaccagaaacagaacctgtggaaaaaacagaacaagaggaagagcaaaaggtttctgattcatacgatgctgggaggctctatgttggaaacttgccatattcaatcactaattccgcattggctgagctctttggagaagctggcaccgtggcgtctgttgagattatgtatgatcgtgtcacggacagaagcaggggatttgcatttgttacaatggggaatgttgaggatgctaaagaggcaattcgaatgtttgatggctcgcaagttggtggtaggactgttaaggtaaacttcccagaggtacccaaaggaggggaaaggttggtaatggggtccaaaatacggaacagttacagaggttttgtagacagccctcacaagatctatgctggaaaccttggctggggactgacctcacagggtcttagggaagcttttgctgagcagccaggcgtattgagtgccaaggtcatctatgagagggacagtggaagatctcgaggttttgggtttgtttcttttgaaactgctgaatctgcacaggctgctttggacattatgaatggtgtggaggtacaaggtcggcccttgcggttgaatttggctgaagcaagggcaccttcatctcctccagtaattcagaaaaatgtaggaagcaatgttgaaagctcggaattggtgtctagtgccagcacataaggaaatatggtcgatcaaaattttgcccgcaaaatgcacgtcattcagcttcttcctgaaaggtttctcttggcaaatttcctgtcaattgctagtcactttggtatacactaactagaccttcaggcagttgtgaaatgtacttgttattgaacatatctataaggggtcgatgttaattatacagtttgtaattatgaaagtctacctttcacagtttggtgaactaataatttcttcaagtggtaattcttttaagtcctaaccttctgttgagagggaaaatactgttggctggtaatagagaaacaagcttggctacgagcatgttccaaagccaataatacttaaact

SEQ ID NO: 2439 - DNA, 1691 bp, Glycine max
  misc_feature: Ceres CLONE ID no. 518274
  misc_feature: Encodes the peptide sequence at SEQ ID NO. 389
ggtttattctgaggcctgtgctgtgctctgaggggccatagtttgggaccctttgaaccctaatctccacccaaacccattttcccgggaaattgccttggaaaagaaagagcgaagaggaaaatgcagaatcacaggctgaagcagcagcagcagcagcaacaacaagctcttatgcagcaagctcttctccaacaacagtctctctaccaccctggcctccttgctcctcctcagattgaaccatatccaagtggaaatttgcctcctggttttgatccaagtacttgccgcagtgtgtatgttgggaacatccatacacaggtaactgagccgcttttgcaagaagttttctcgggtactggcccagttgaaggttgtaagcttatcagaaaggataagtcatcctatggattcattcattactttgatcgcagatctgctgctcttgccatattatctctcaatggaaggcatctatttgggcagcctatcaaagttaattgggcatatgctagtggtcagagagaggatacgtcaggtcactacaatatatttgttggcgatctaagtcctgaggttactgatgctacgttgtttgcatgcttttctgtctatcccagttgttcagatgcaagggttatgtgggatcagaagactgggcgttcaaggggatttggatttgtttcattccgtaaccaacaggatgcacaaagctctataaatgatttgactggtaagtggcttggaagtagacagatacgttgtaactgggcaacaaaaggtgctggtggtaatgaagagaagcaaaactcagatgcaaaaagtgtggtggaacttacaaatggctcatctgaagatggtaaagagacatctaacagtgatgctcctgagaacaatcctcagtatactactgtttatgtgggtaaccttgctccagaggtaactcaacttgatctccatcgccacttccatgctcttggggctggagtgatggaggaggttcgggtccagcgtgataaagggtttggttttgtgaggtacagtactcatgctgaagcagctctggctattcagatggggaacgcccagtctcttctatgtggaaaaccaattaagtgctcttgggggagcaagcccactccacctggaactgcttcaaatccccttcccccacctgctgctgcatctctgcctggcctgtctgcaactgatcttttggcgtatgagcgacagctagcaattagcaagatgggtggcgtccacgccttgatgcatcctcaaggacaacatcatcttaaacaagcagcagctattggagccagccaggcaatatatgatggtgggttccagaatgttgcagctgcacagcaaatgatgtactaccagtaacacacttcggttctcttgatgtattggggtttaatgctagctatatattctgccctgtgcacattgattcgtgttaaactctagggagccttttctttttacttttttacccgacggtagtgttgtagttacacctaccatattagacaattatgagtaaacatttgtatgggtttgtatcatgtatgcggttttctacttaatagtggtgagtgtttatgattttaagaggggattgtctgttcagacatgtttcttctcatcacccatttgggtgttactatgcgatagttgtcatc

SEQ ID NO: 2440 - DNA, 1339 bp, Glycine max
  misc_feature: Ceres CLONE ID no. 518521
  misc_feature: Encodes the peptide sequence at SEQ ID NO. 1938
gaatcaattgatgtcttgtccttctcctccctcagttcctcttcactccctttcattctccctcgcctcacacgcacacgcacacttgtcattctcaaaacacgcccaaattcgaatcaaattagggttagggtttccaactcccctcgaattatccctgtaatgcagtttaattcccgggtcctactaccatggagccatcagcaatgtacggacactcccagcccctgagcatgccctcgcagatcggcggcggcgaaagcgacgacggctccggaaacgagcacgccgtcgacggccaccaccaccacattcagtacgaaacgcacgcgctcgaggacggtgccgccgtcgtcgtcgaggatgttacctcggatgcggtctatgtctccggcggtggaggccccgtagagtccagccagcttacgctgtcgtttcgtggccaagtgtacgtcttcgatgccgttacgcctgataaggttcaagcggtgttgttactgttgggtggatgtgaactatcttcaggtggttcgccatgtgtggatccgggggctcaacataatcaaaggggttcaatggaatttcctaaatgtagtctaccacaccgagctgcctcattacataggttcaggcagaagaggaaagagcgatgctttgacaaaaaagtgagatatagcgtgcggcaagaagttgcgctcaggatgcaccgtaacaagggccagtttacttcatctaagaaacaagatggagctaatagttatggtactgaccaagattcaggacaggatgatagtcaatccgaaacctcatgtacacattgtggcattagttcaaaatccaccccaatgatgcggcgagggccatctggtccaaggtcactttgcaacgcttgtgggcttttttgggcaaataggggtgctttgcgagacctttctaagagaaatcaggaacactctcttccaccagttgagcaggttgatgaaggtaatgactcggactgtcggactgccactgccgaccctgcacataacaatcttcctgctttctcagagcatgataatccagctttggtagctgatcataaagttttccagtctcagaaaatgttgaagtagtttactctggcataagtaggtctatagttcttccattcagattgaccaataggaatgtacagacataacaatactcccatcaatgcaagaactttgtttttatatggttggatctatggcattaaccattgatctctggatgtataacctgaaacttgaatgatgacttggtgatggtctcacccaataccttgaatttaattttacaaaaaaaaaaaaaaaaa

SEQ ID NO: 2441 - DNA, 1788 bp, Glycine max
  misc_feature: Ceres CLONE ID no. 523155
  misc_feature: Encodes the peptide sequence at SEQ ID NO. 1744
aaaagcctaacgaaccctaattcttgattattcctcaattctttgttcccttcccatcttggggacacaaattcgccttcttcctcatttcgcaaacaaattcctcttccaagcatccccaattttcttttaatctattttttcgcctttttatttcacccatttaaacctgtggcttcttttcgacgccccccccccccatgtgtcagaatggattagtgtaaattattgaaagatacccatatataaaagcatgggtagtagtgacatggacaaaactccgaaagagaaggagtctaagacacctccagctacgtcacaggagcagtcatcaacaactgccatgccaacaactaatcctgactggtctaactttcagacatattctcctatacctccacacgggttcttggcatcaagtccccaagcccacccatatatgtggggcgtccagcattatatgcctccctatggcactccaccacatccctatgttgcaatgtatccccatggtggcatatatgctcatccatctattcctccgggatcttatcctttcagtccttttgccatggcttctccaaatggtattgcagatgcttcgggaaatgccccaggccgcatcgaagttggtggtaaacctcctgaagtgaaggaaaaattacctatcaaaagatcaaaaggaagtgctagtggtggtaatttgaatatgtggattacagggaaaaataatgaacctggtaaaataccaggagaatctgctaatgggattcattccaaaagtggtgagagtgcaagtgacggaactagtgaaggaagtgatgagaactcccagaatgattctcaattgaaatcaagggagaggcaggactcttttgaagatgaaccatctcaaaatggaagttcagtacatgctcctcaaaatggggtacataatagacctcagacagttgttaatcaaactatgtctatcttacctatatctaccacaagtgctcctggagcagttcctggtcccacaactaatttaaatataggaatggattattggggcacaccaacttcgtccaccattcctgcattgcatggaaaggttccttctactgcagttgctggagggatgattgctgctggatcacgagatggtgttcagtcacaagtttggctgcaggacgaaagagagcttaaaagacaaaggcggaagcagtctaatcgggaatctgcacgcagatccaggttacggaagcaggctgaatgtgatgaactagctcagcgtgctgaagctttgaaagaagaaaatgccactctccgatcagaagtgagccagatcaggagtgagtatgagcagctacgttctgagaatgctgccctcaaggagagacttggggacatacctggtgtcgcgacgcctgggaaggaggatcttaggtctggtcagaatgatcagcatgtgagtaatgacactcaacagagtggtcagacagaggttgtgcagggtgttcattaggatcttgcttcctgctgcatgttgctttttaggtagataacctaaccaagtagcaacagcaagttctagtttttggttcaaattgtattaaaggtgatcatatgtagtattaggatctatttatgtcatatgatccctcattcctaatttgtcatgtttatgacggccaaaaacttgtattgtagttagtgtgtgaatacttggttataccttctctgctacttcaaaagttagtgttagcagtaagaaagtatgattagtgaaactagttattgtccatc

SEQ ID NO: 2442 - DNA, 940 bp, Glycine max
  misc_feature: Ceres CLONE ID no. 529239
  misc_feature: Encodes the peptide sequence at SEQ ID NO. 1235
acccaaaattgaacaagaagtcctgagaaggcatctagaacaaagctctgaatctgatttttgaaaactggaacgcgtaaaatgaacggtacccctccctcataaataaaatctactactaaacgctcttctcttytgcaatcaatttgcaaaccaaacacaacacaaggagaagaaccagatctctctttctcaaatcaccaagaatagttgaaaatggggctgtctttcacgaagctgttcagccggctctttgcgaagaaggagatgcgtattcttatggtgggtctcgacgccgccggtaagaccaccattctctacaaactcaagctaggagagatcgtcacaaccattcccaccattgggtttaatgttgaaactgtggaatacaagaacatcagcttcactgtctgggatgttggtggccaggacaagatccgtcctctgtggagacactacttccaaaatacccaagggcttatctttgtggttgatagcaatgaccgggatcgtgtggttgaagctagggatgagctgcacaggatgttgaatgaggatgagttgagagatgctgtgcttctagtttttgcaaacaagcaagatcttccaaatgctatgaatgctgctgaaataactgataagcttggtcttcattctcttcgtcagcgtcactggtatatccagagcacatgtgccacatctggtgaagggctttatgaagggcttgactggctctcaaacaacattgcaaacaaggcatagtgattatcggtcatgggttgcatcaaagttcatttgagtttagcggttgtgacttccaatgtttgatgtgcttaccctgtttagaatcttattttctctagcatgtattatttgtcttcgataaagaacagattgtctactacctaatatcaaaataatttgcattttttctccgtgc

SEQ ID NO: 2443 - DNA, 696 bp, Glycine max
  misc_feature: Ceres CLONE ID no. 530235
  misc_feature: Encodes the peptide sequence at SEQ ID NO. 1943
ataaaaagccccaaatttctccaacgctatcgagccaaacccaaacgttaactcagacgaagcaccaacagaagaagaagaaacaaaaccgaacctctctaaactctccaacgtcgccacccgattcatcgcatttcgcaggctgcaatggcgacgttcgaactgtaccgcaggtcgacgattggaatgtgcctgacggagacgctggacgagatggttcagaacggcactctaagccccgagctcgcgattcaggttctggtccagttcgataagtccatgactgaggctctggaaacgcaagttaagagtaaggtctccatcaagggacatctccatacatatagattttgtgacaatgtttggaccttcatcttacaagatgctttgttcaagagcgaagacagccaagagattgttggacgggttaaaatagtggcgtgtgactcgaagttgctcacacaataatgtgcctaatttctgccattgtcgacaaggacaaattgttgtcatctgctggtactatgggaatggtggccagaccatagttaaaatggtcttaaattcttgcaggaactagcaactattgtatgttattattatagatttaaaagccatcagtcttcatatcattaggtaattaatgctacaatgagaataccgcttggaaattgaatgaatctactcccttctttt

SEQ ID NO: 2444 - DNA, 1381 bp, Glycine max
  misc_feature: Ceres CLONE ID no. 537080
  misc_feature: Encodes the peptide sequence at SEQ ID NO. 1932
ttttctccaatatgtatagatctggagcaggcatggcttggaacgtgtttaggttctgcactgccctgagaggattaggctcgatcatgatactaatggttcttggggttgtgggtgttacctattacgctgttgtgttgactaattttggacctgccttgtttcttggaggccttgatactcttatctccttcgtggtgttgatcttgtttcattgtttgttggttatgttattgtggtgttactttgctgttgtgtttatggatccggggactgtgcctcctaactggaagcctgctgctgatgaggagagaggagaggttgatccgttgaatggggtagaattaagtaatctgcagtctgatcctgcaaatcaacggttcagatactgtcggaagtgcagtcagcccaagccacctcgatgtcatcattgttctgtttgtggacgttgtgtactgaagatggaccaccattgtgtctgggtagttaactgtgttggggcattaaattacaagtatttcctccttttcttggtctacactttccttgagaccactcttgtgactatatcattactgccacatttcaaaacatacttttctgacggagaaattcctggaacacctggcactcttgccacaacttttcttacttttgttttgaatctggccttttccttgagtgtcttgggatttcttgtcttgcacgtgtcattggtagcttctaatacaaccactattgaggcatatgaaaagaaaactacttcaaaatggcgttatgaccttggtcgtagaaaaaattttgaacaggtttttggaatggacaagagatactggttcatccctgcttattcagaggaagatatacgaaggatgcctgttcttcagggccttgagtatccatcaacaccagacttcaatgcccaagagttctgagagccattgccacatcagaagagaaactgtttttaccttttgcaacagaaaacatggagcatccatagcctcttgttttggtctctaagagaatctgtagcattgaggtatttaagatccggacggcaatttgtttgcataggcacttggcatgattaatgttttttttccttctttgatgagtcgtgtgcttgtgccaagttcaaatggtgagcaacgaggagcttggtttaaaggtttgactagttaattgatgtgttcaaattcctgaaaatgttatctcactcacgattaagaactatacatggattttcacctgttcaattttttacccttcattagtcatacactgatgttgcttggaatgattgtcgattgaagttttacaatcaactattcctttgcatagatgatgttcaaatgtaatacgaattatactttcctgt

SEQ ID NO: 2445 - DNA, 1092 bp, Glycine max
  misc_feature: Ceres CLONE ID no. 537752
  misc_feature: Encodes the peptide sequence at SEQ ID NO. 846
tcttctttttccttctttctccacaagaagccacacacacctctgtttctttctctgctccacactttctcttcctccattattgagcttccactagttttttttcccctttctttcttccaaggacttaattgcactgcttaaagtctcaagctttacaacttttggaagatacccattttttgcagccatcacttacttgcccaagaagagaggggctttcttttggtttcaaccattttctgcttttggcttcaaaaggaacatcatagatgatagccagctccttctgcaatgctgattctatgttttcaagagaagaggggatagatgttagaaagatgatggaacataaaaggagaccctgctctgttgaccaaagcagttatacttctattgcatctaaaaggcaaaaggctgatttatcgatcagcactaaggagaggaaggaaaagattggcgaacgaattgttgctcttcagcagcttgtttcaccatatgggaagacagatacatcttctgttctaaaggaggcgatggaatacataggattccttcataaacaagttaagctgcttagtgctccataccttgaaagttcaccagcagccaagatgcagggtgtggagccatgcagcctgaggagtagaggcttatgtcttgttcctgtgtcagttactattggagttgctgagagcaatggtgcagatatctgggcccccattaagactactacttctcctaaatttgagaaggatgtctcccaatttcattgacaaattttctcatctttgcagcctaaaggttgctaaagttgctaaactagcatgaaaattactatgatgatacatctagatggaatcatagtagctatatatatatatataatagttaaagcattaaaaaaaaaaactctagtcaaaaagctgtcccacacctcttagattttaaacgggtgatgggggtaagcttccaattagccatatgtgcccttaattaattaattccatgtgctgattattaagtgtatatttgaaaaattctagttgtataatgtttccatgaactgattagtttaatcaaagtcgtttc

SEQ ID NO: 2446 - DNA, 762 bp, Glycine max
  misc_feature: Ceres CLONE ID no. 538817
  misc_feature: Encodes the peptide sequence at SEQ ID NO. 1408
aactttttctagctagctagatcatcaatctctctttcagttttccttgaacctatggacggaagttggagtgagggaaaaaggagcatgagttacaaggaggaggatgagtacgaagaagaggaagaggaggaggtgagtgagtatggagatgatggtaagaaaaagagggtggtgagtaataagagagggtccaaagctggaggctcagtgccaccttcatgtcaagttgatggttgcaacgctgatctaagtgaagctaagccctaccataggcgtcacaaggtttgtgagtaccatgccaaggctcctgctgtagtcattggagatcagcaccaacggttttgccaacaatgtagtaggtttcatgagctatcagaattcgatgactcaaaaaggagttgcagaagacgtttggctggacataatgagaggcgtcgcaaaaatgcatctgagtatcacggactttgatgagatggacaacaataaatatttgtgcaagataatataacaataacaacaacaaaaagaaagcctttgtyttaggtgagcaaggcaagacaagcagcaacaaataatttaaataatgtctcccataatatatgttattggcctatatatgagaaaaagctctatcttcaaatttttttcacatatatatatatatatatatatatatatatatatatatgctaaaattgctgtggggtaattaattatatccaagagaatattataaaaaaaattgcttgccattaatac

SEQ ID NO: 2447 - DNA, 1063 bp, Glycine max
  misc_feature: Ceres CLONE ID no. 539578
  misc_feature: Encodes the peptide sequence at SEQ ID NO. 1571
aactgccattacaaatggtgttaggaaaggggcggttctgtgtacatcaacgtgttcacttatgaaccaaactttttggccccattcccatgcttcatcgtcaatggttttgggatgagatggttccatccaagacttaaaagacttcatggcccccatcttgcacacacgtactagtactacacatacacttttttcctttttccaaaatccctttgttgttgtagctacccttcagagcaaagagagagagagagagagagatgtctcttccaagacccagtgagggtaaagccccttctcagctgaaagaaggagtagcacctgctgctgctgaagcctcaacctcttcttcatggaataataggctaaacacttttcctcctttatctctacacaacaagaatagcaaaattgaagacagtgatgaggatatgttcacagttccagatgtggaagccacaccaattaatgttcattctgcagtgactcttcaaaatagtaaccttaatcaacgtaatgtaacagaccctcaatttcaatctggctttcctggaaagcgccgcaggggaagaaatcctgcagataaggaacatagacgcctcaagaggttgttgcggaatagggtctctgctcaacaagcccgcgaaagaaagaaggtttatgtgaatgacttggaatcaagagctaaagagatgcaagataaaaacgctatcttagaagagcgtatctctactttaatcaatgagaacaccatgctgcggaaggttcttatgaatgcgaggccaaaaaatgatgacagcattgaacaaaagcaagaccagttaagtaagagctaacaagcaaagctagagggtgcgtcaaagtaaggcattcaagagatgcatttatgatttattttagacactagaaattataaatttataaatatattattactttatttctttactcgttattatacttccctcaagactatagatttgaattaaaaagaaactttattgtgatgtaaagttttagtcagactatatataaaaagccatttacaatttgtcattct

SEQ ID NO: 2448 - DNA, 577 bp, Glycine max
  misc_feature: Ceres CLONE ID no. 541062
  misc_feature: Encodes the peptide sequence at SEQ ID NO. 1689
tctcccgtgtcgtgtcgtgtcttcttctctaaaataaaaaaccctaacttctgaacctttcaccgcatcgccaccgattccctatctccactaatcaaagaaaagaaaatgagtagacgctcgagcagaactgtctacgttgggaatctacccggtgatatccgtgaaagagaagttgaagatttgtttctgaagtacggacacataacacacatcgacctaaaggttcccccaagaccacctggttatgcatttgtagagtttgaagatgctcaagatgctgaggatgcaattcgtggtcgtgatggctatgattttgatggccaccggttacgggtggagcctgcccatggtgggcgtggtcattcatcctcaaaagatcggcacaatagtcacagcaatggccgaggtggacgtggggtatctaggcgctctgaatatcgtgttctagtcactggattgccctcttcggcatcctggcaggatcttaaggatcacatgcscaaggcargggatgtttgcttttctcaagtttttcatgatggaaggggtactaccggtattgkggattacacaa

SEQ ID NO: 2449 - DNA, 1383 bp, Glycine max
  misc_feature: Ceres CLONE ID no. 543289
  misc_feature: Encodes the peptide sequence at SEQ ID NO. 2036
agctagcaattatacgctcctttatatattgtttccgtgtttttctctctttgtgattttgtgaggcccaaactaactttataagcatttacgtgtttgaaattaatattttgtgagctagctagcttcttcatcatggcaaagtcttctactgaaaagaatggactgaagaagggtccatggactccagaggaagatcagaaactcatcgattacattcagaaacatggacatgggaagtggagaacccttcccaaaaatgcaggactaaaaagatgtggaaagagttgtcggcttcgctgggctaactacttgaggcccgatataaagagagggagattctcattcgaagaagaagaagccatcattcagttacacagtgttttgggaaacaagtggtctacaattgctgctaacttgccaggaagaacagataatgagatcaagaattattggaacactcacatcaagaaaaagctattgaagatggggattgatccagtgactcacacacctcgccttgatgttattcaacttgcctccattctcaacacatctttatacaattcagcaccccaattcaactacccttctctttctggaattggaagatcagtgataaacccaagccatatgctaggtttgctcactaccctgctatcatgtcaaaacagaaattacaaccctgatgtattgaataataaccaacttagtggtggtagcactctactgcaaaatcaacaccaatgttcccgaatgcaacttgattctacacaagccttccaaccaaaccaaccacaagtctcactacaagaaaaccacattgctaagtctaattctaatccattgaatatggaaccccaagttatgaaaactacattagagaatcaaatcactccaattgctaccccttttagccaacaaaacacactaccaaatttgtggcactataatactgaaggtcacatatctgatctaccaacaatggctcaatcatcatcagctatgcaatgtttctcttctcccaagttcaattctatatacaacaatctcttggaaaatcagaatttgtgtaacaacaacgaggggatgccaaatttcaatctaagttcactgttatcgtccacaccctcatcttctagcccaattagtactttgaattcgtcatcttccacaacatttgtcaacggaaccactgaagatgaaagggacacttacggcagcagcatgttgatgtataacatttcaaatggcttgaatgactctggacttttgtgattgtacaagttgtgctgctacgtgatttagtttttcttttttctttttttgagatcagtgacatttaatgtcattaaaacagaaataatattatataattattat

SEQ ID NO: 2450 - DNA, 1768 bp, Glycine max
  misc_feature: Ceres CLONE ID no. 545441
  misc_feature: Encodes the peptide sequence at SEQ ID NO. 1739
tgccatatttcccaaataaaattccccgattaaccttcgtgctacccacgaaatctatttttcttcccatttttttctgagcatttagctgtcgcttctttttgtttgtttttgtcatcctcggcagatcaggttttgtttttgcttctgctccagctttggaagatccacaatctctctctgagtggatggtttagtgtatatttttaagatactgatataaaagtatgggaagcagtgagatggataaaactacaaaagagaaggagtcaaagacgccgccaccacctacatcacaggagcagtcttcgaccaccggcactggaacaattaatcctgagtggcctggctttcaggcatattctcctatacctccacatggtttcttggcatcaagtccccaggctcacccttatatgtggggtgtccagcaatttatgcctccctatggtactccaccacatccctatgttgcaatgtatccccctggtggcatttatgctcatccatccatgcctccgggatcttatccttttaatccttttgccatgccttctcctaatggcattgctgaggcttcaggaaacactcctggcagcatggaagctgatggcaagccttctgaggtgaaggaaaaattgccaatcaaaagatcaaaaggaagtttgggtagtttgaatatgatcacagggaaaaataatgaacatggtaaaacactggggacatctgctaatggaattcattcaaagagtggtgagagtgctagtgaaggtgaaggtaccagtgaaggaagtgatgcaaattctcagaatgactctcaattaaaatcagggggccggcaggattcttttgaagatgaaccctctcaaaatggcagttcagcatatactcctcaaaatgggggactaaatatacctcatacagtggtcaatcaaaccatgtctatcatacctatctctgcaggtggtgctcctggagctgttcctggtcccacgacaaacttaaatataggaatggattattggggtacaccaggttcatccaacattcctggacttggcagaaaggttccatctactgcagttgctggagggatggttactgttggatcacgggatagtgctcagtcacaactctggctacaggatgaaagagagcttaaaaggcaaaggcggaagcagtctaacagggaatctgctcgcaggtccaggttgcgcaagcaggccgagtgtgatgagttagctcagcgtgctgaggctttgaaggaagaaaatgcttctctccggtcagaagtaaatcgaatcaggagtgattatgagcagctactctccgagaatgcagctctcaaggagagacttggggaactacctccgaatgatgatcatcatcataggtctggcaggaatgatcagcatgtgggtaatgacactcaacagagtgggcagacagaggccgtgcagggtggtcattagcaccaaccaaccacttcatgctgcctttcagggagataatctaacttaaatagcaagagcaagatcttgtttcggataggttgtagttcaaattgtattaatgctgaccatttatcgtcttaagatctgtttaatgttatgtgatccttcattcctaatttaccttttttttaactcattcaaaacgacctggattgtatgtagtgtgtgaattctgtgtcataccttatctgcagcttcaaagttagtgttctcattaagtaagcaatatagttaccaaaaaaaaaaaaaaaaaa

SEQ ID NO: 2451 - DNA, 1469 bp, Triticum aestivum
  misc_feature: Ceres CLONE ID no. 555364
  misc_feature: Encodes the peptide sequence at SEQ ID NO. 1079
  misc_feature: Encodes the peptide sequence at SEQ ID NO. 1646
  misc_feature: Encodes the peptide sequence at SEQ ID NO. 1761
attcgactcgacgccctcggttcacacacactgatcagctcagctacagcctacagagtacagacccaacccaactccgggagacaacagagcagagcacggcgagaatgctgctgaacccggcctcggaggcgctggtgctcgacagcatcaggcagcacctcatggaggacacggcggcgccggcgccggaggcgaggaggcagcggccggcctactgccgcagcgccagcttcgggagcctggtggccgaccagtggagcgagtcgctcccgttccgcgccgacgactccgacgacatggtcgtctacggcgcgctccgcgacgccttctcctgcggctggctccccgacggctccttcgccgccgtcaagccggagcccctcctgccttccccggactcctgctacgtcggcttcctcgagccggagacgcctccggccacgtccccgggagagagcgaggaggaggccgccgcggcgttcatgggcgaggcggccgcggccgcggcgagggggaagcactaccgcggggtgaggcagcggccgtggggcaagttcgcggcggagatccgggacccggccaagaacggcgcgcgcgtgtggctcggcacctacgacaccgccgaggacgccgccgtggcctacgaccgcgccgcgtaccgcatgcgcggctcccgcgccctcctcaacttcccgctccgcatcggctccgagatcgccgccgcgcacgccgcggccgcggccgccggggacaagcggccttcccccgagccggcgacctcagactcgtcgtcgtcctcctcctcctccgggtccccgaaaagaaggaagaggggcgaggccgcggccgcgtccatggccatggcgctggtgccgccgccctcgcagctgagccggccggcccaggcgtggtaccccgcggcgccggtggagcaggtggccatggcgccgcgcgcgcagcagctggtcagctaggccccgctcgccagcccccgggcgcacgatcggtcgtaaaagcacacaatgcgcaagtgcaatggattcgccagcaagtgcatggacgcgacagcaacaggagcccgcctttcactggtgcacggtgcaaggtggtgatggcaatggagagcgatggcgagcgagcgagcgagcaatcaggcaaagcaaccttggcgacggctccatttggatatttggatgggtcgagccgtcgacaacggaagataagctcggagcaactgggtgctgcaatttggcctggaatgatagttcctcctctctccactgctcggtgcaactcgcccaagtggatcaaagcgaaactgtgccagtatcggatcgtcgtggttccttctgagtcgtagggttatattttgtcactgtcagagtgcgtgtggtaaaaattacaaactcgtgaatcgtgatcgagcataatggaacttgtgaaactttacaaaaaaaaaaaaaaaa

SEQ ID NO: 2452 - DNA, 509 bp, Glycine max
  misc_feature: Ceres CLONE ID no. 556120
  misc_feature: Encodes the peptide sequence at SEQ ID NO. 550
gaaaaacctcttgttgagagttgaaacacacctactacaattgctaaagtcctttcttgtcatagcaaaaatgaagcttgtctttgccaccctactgttatgttctcttcttctaagctcctctttcttggagccagtcatcgcctatgaagactcgtcttattgcagcaacaagtgttcggacagatgctcatcggcaggggttaaggataggtgtctgaggtactgtggaatatgctgtgctgagtgcaaatgtgttccttctgggacctatgggaacaagcaccagtgtccttgctacagggacaagctcaacaagaagggcaagcccaaatgcccatgaagtcttgaactcaaagaccaagtcacatagagacttaagagaataagactggtgtttgtgtttacaattacatcgtgaattcccaagcataatggttggactcttgtttccaatgtctgttggatatatgttagatctgaacgggaataaattacatatcttggat

SEQ ID NO: 2453 - DNA, 771 bp, Glycine max
  misc_feature: Ceres CLONE ID no. 560681
  misc_feature: Encodes the peptide sequence at SEQ ID NO. 1788
  misc_feature: Encodes the peptide sequence at SEQ ID NO. 1815
atatatcttagccttttctctccctcccttctcccatattatatagcttgtcttttatttcttagactccatccattcttctccccaattgaatcttctttattttgtttcttcactgtctcgttatggctatagttttgcatagtaaataaactgaactgaagctatctatatagcagcaagtgttgatttaattacttactttagacaataattatattaattacaccaatttataagctctttatctatctatctagctagggaaaattaaaatgtctagcagaaggtccaggcagcaatctgcatccacaaggatctccgatgaccaaatcatcgacctcgtttcaaagttgcgtcaacttgttcctgagattcgcgataggcgctctgacaaggtatcagcatctaaggtcctacaagagacctgcaactacatcagaagcttacacagagaagtggatgacttaagcgaacgactgtctcagttgttggccacaatcgatgctgatagccctgaagctgccatcattaggagcctaattaactaataatatatattaagcgcaagtaatcatctaattttcctatattcaaggagatatattataagagtgtattaatttcttcttytaaattaggtggcatagagtgcagtttgaggtgcgtacgtacgtccttccaatatattatagtacatggcaggaatggtgcacttgtgtaagttaaaggtttttgcaataagaactaaggactctctgtattatggcg

SEQ ID NO: 2454 - DNA, 790 bp, Glycine max
  misc_feature: Ceres CLONE ID no. 562428
  misc_feature: Encodes the peptide sequence at SEQ ID NO. 1789
  misc_feature: Encodes the peptide sequence at SEQ ID NO. 1816
atatcttagcctttccctccctcccttctcccatattatatagcttgttttatttcttagactccacccatcatttttcattgcatcttcttcaatttgtgtgttcactctctcctcgtggctatagttttgcacagtaaataaactgaactgaagctatatagaagcaagtggtgattaattacttactatagacaattatatatatatatatattaattacaccaatttataaggtctttatctatctagctagctaggtaaaattaacatgtctagcagaaggtccaggcagcaatctgcatccacaaggatctccgatgaccaaatcatcgaccttgtttccaagttgcgtcaacttgttcctgagattcgcgataggcgttctgataaggtatcagcatctaaggtcctacaagagacctgtaactacatcagaagcttacacagagaagtggatgacctaagcgaacgactgtctcagttgttggccacaatcgatgctgatagccctgaagctgccatcattaggagcctaattaactaataatattaagcaagtaatatcagctcattttcctatatccaaggagatatataagagtgtattaatttcttcttcttaatttaggtggcatagagtgcagtttgaggttccttccaatatttatagtatatggcaggaatggcgcacttgtaagttaaaggttttgtgataagaattaaggactctctgtattatggctatagtgctatatattaatatatgcatgccacatttatagatgcc

SEQ ID NO: 2455 - DNA, 1687 bp, Glycine max
  misc_feature: Ceres CLONE ID no. 562894
  misc_feature: Encodes the peptide sequence at SEQ ID NO. 375
ggctcttcggtcagaagatccctttccctgaagatgttgacaaagaagaagagagtgctgaggatagagaacaagagatggaagaacatgaagacgaaggagacaaggatactagagttgaaaatgttactaaggaagagctagaagctgatcctcctctagatgctgaagagactaagatttcaggcacatcccctgaggctattgtgaaccccaaaacaccttccatagaagaagaaacagcaaaatcaaaaggtggcaaatcagagaaggaacaaggcgatgcagccaactcacaagagaaaaccctgaagaagcctgataaagtgctaccatgcccccgctgcaaaagcatggacactaaattctgttactacaacaactacaatgtcaaccagccgcgttatttctgcaaagcctgtcaaagatactggactgcaggtggcaccatgaggaatgttcctgtgggggcaggacggcgaaagaacaagaactctacctcgcattatcgccacatcactatctccgaggcccttcaagcagcaagaattgatgctcaaaatggaactcatcttccaactttgaaaggcaatggtagagtcctcagctttggattagatgcacatgcacctatttgtgattccatggcatctctcatgaatcttggagagaaaaaggctcttaatggcacaagaaatgggtttcatcatggctttgaggatcaaagactccccgttccttgcaaaagtggggaaaatggtgatgactcttcaactacatcctccattacaatttcaagtcccaagggagaaaataacaaaagcaccttccaacaacaaccattgccccaaaatcatggtttccttcctcaagttccatgcattcctggtgttccttggccctatacatggaattctccagttcctccacctgctttgtttccttcaggatttcccctaccattctatcctgctacattttggaattgtggcatgcctgggaattggaatgttccatggttttcctcaagttcacctgcttcaaacctcaagtctccaagctccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtttaaggccttccaatcgaagaagggtgaaaagaatcatgttgaagcctctccaatgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcggcacaagtgagacgacgaggactaattctgtctttaatttcattcgacaatattaaaatagagtatataggttttttttcatgtgcttagtttgatgagtgagttcatgtatatgtacatatataaaaatatgtgaaatactgatctttagcct

SEQ ID NO: 2456 - DNA, 1335 bp, Triticum aestivum
  misc_feature: Ceres CLONE ID no. 569584
  misc_feature: Encodes the peptide sequence at SEQ ID NO. 910
acacccacccaccccctcctccttacttgacctagaacctggcctcgggccgacgcctcctgctccctctcgctgtcgcgtctcccggcgatcctctccgtcgacgccccggctagccgccatcgtttcccggcgaccagatcgacggcaatcccatcctccttgatctccctctcgggcgtcgggagatctacgtggggacatgcataagctggggagaggaagccgcgacaaggtgcaacagttcatggccataactggtgcaagcgagaaggtcgcccttcaggcactgaaagctagtgattggcacttagaagggtcttttgattatttctacagccagccacagatttctgtgaccaattctcgacatctttacagcagatacaaagaacgtgatgctgatatgatcatggtggagggcacatctcaactttgcaacgacctgttggtggatcctcaggatgttgtcatgcttgtcatatcatggcacatgaaagctgccacaatgtgtgaatttactcgccaggaattcattgatggtctgcagtcaattggggtagattcaattgagaagctccgtgagaaacttccatcactgcgagctgagataaaggacgataataagttccgtgagatatacaactttgcatttgcttgggctagggaaaagggtcagaaatcccttccactggagacagctattggaatgtggaggttgctgtttgctgaaaggcattggcccttaatcgatcactggtgtcagtttctccaggtcaggcataacaaagccatctctagggacacatggtctcagctgttggaatttgttaagacaattgatccacagttatccaattatgacgaagaaggtgcttggccctacctaattgatgaatttgtggagtacctaaccgagaatggatgcgttcagcgtaacaagtgaaccattcgaggctgcattctgacttggatatcatgatttggtggtacaaacatgattcatgtcgatcaatagaatatttatctttggatgtcggcattgttccagctccccttcacaaagcagatgatgtcgtttggtggaatctacttgcgcaggggtgatttcactggctaggattgcaaactatctatctggtttgtattttgtgctgcacctatctgctacagcatacccaaaatagttattggtttactgctgaatgggcgatgggtctatagttcatgtaggtctaggtatgaggtaatgcgaacttgtgctatcggtattgatcgattgttgccagatggggcacctttctatgaggtaatgcaaacttgtgatatctttcg

SEQ ID NO: 2457 - DNA, 1323 bp, Triticum aestivum
  misc_feature: Ceres CLONE ID no. 569593
  misc_feature: Encodes the peptide sequence at SEQ ID NO. 1648
  misc_feature: Encodes the peptide sequence at SEQ ID NO. 1763
attcgactccacaccctcggttcacacacagtgatcagctcagctacagcctacagagcacagacccaaccccgggagacaacagagcacggcgaggatgctgctgaacccggcctcggaggcgatggtgctggacagcatcaggcagcacctcatggaggacacggcggctccggcgccggaggcgaggaggcagaggccggcctactgccgcagcgccagcttcgggagcctggtggccgaccagtggagcgagtcgctcccgttccgcgcggacgactccgacgacatggtcgtctacggcgcgctccgcgacgccttctcctgcggctggctccccgacggctccttcgccgccgtcaagccggagcccctcctgccttccccggactcctgctatgtcggcttcctcgagccggagacgcctccggccacgtccccgggcgggagcgaggaggaggccgccgcggcgttcatgggcgaggaggcggccgcggccgtggcgagggggaagcactaccgcggggtgaggcagcggccgtggggcaagttcgcggcggagatccgggacccggccaagaacggcgcccgcgtgtggctcggcacctacgacaccgccgaggacgccgccgtggcctacgaccgcgccgcgtaccgcatgcgcggctcccgcgcgctcctcaacttcccgctccgcatcggctccgagatcgccgccgcgcacgccgcggccgcggccgccggcgacaagcggccgtcgcccgagcccgcgacatcggactcgtcatcctcctcgtcctcctccgggtccccgaaaaggaggaagagaggcgaggccgcggccgcgtccatggccatggcgctggtgccgccgtcctcgcagttgagccggccggcccacgcgtggtaccccgccgtgccggcggagcaggtggccatggcgccgtgcgtgcagcagctggtcagctaggccccgctctccagcccccgggcgcacgatcgtgaaagacaatgcgcaagtgcagtggattcgccagcaagtgcatggacgcgacagcaacaggagcccgcctttcactgttgcacggtgcaaggtggtgatggcaatggagtgcgatacctatcgagcgagcaggcaaagcaaccttggcgacggctccatttggatagatatttggatatttgatggcaatggaagataagctctcggagcaactgggcgctgcaatttggtctggaacgatagttcctcctctggctgctcggtgcaactcgcccaagtgggtcaaagcgaaactgtgctagtatcgggttgtcgtggtt

SEQ ID NO: 2458 - DNA, 1111 bp, Glycine max
  misc_feature: Ceres CLONE ID no. 572426
  misc_feature: Encodes the peptide sequence at SEQ ID NO. 701
tttttttttcgacaaaaccgttacccttcgtcgtcttatacctgattcttcatctccgttcgagggtcaacacttgaagatcttagctcgtggcaatggccgattctccaccgagaaggaattcaaggtccccttccccatggagggctgagtcaaggtctaggtcaaggtctagatctaggcctaggtctaggtcccggtcaagatcttttgagaaacaaaggccaagatcccggtcgagaagtcgtggaagatcaagatcaagaagtaacgaaaggtctgaggctaaaaatgctggaactacactttatgtgactggcctgtcttcaagggtcactgagagagacctagaggagcatttctctaaggagggaaaggttgcttcgtgctttcttgtggtggagccgcggacacgaatttctcgtggttttgcttttattacaatggatactgttgaggatgcgaaccgttgcatcaaatatctcaatcaatcagttttagagggtcgctatattactgttgagcggtcacgaagaaagcggccaagaactcctacacctggacactatcttggccttaaaagtactagagactatgggcatcgtggtgaccatggaaggtatcgaggaggtggatctggtcatgatgattatggatatcgtggtgaccgtggaaggtctccaaggcactcaccaccatatcgaggtggtagagattattcaccgaggcactcacccccaccttatggtggaagatctaggagggacaggtccaggtcacttccttattctccatatggtagcccagataggaggtatgctcgtggatctaggtgatgtcttttaagtttgaagatggtaatgaaaaaattatctattatggtatcgtgactaaagtttgtatccatgttttggaaatagtctgcactacttatgctttaatttgtacacttatatttgttcggtatttaactagtttatacaattcataatttattggtcaaattgttctacaagacctcgtatcagtactcggtagagttccactttgtctctgatctttttttagttcgtttcttcgtactaataaataaaaagtcgcaattttgagt

SEQ ID NO: 2459 - DNA, 1267 bp, Glycine max
  misc_feature: Ceres CLONE ID no. 573215
  misc_feature: Encodes the peptide sequence at SEQ ID NO. 1955
atcgatcacacagcttttgttctcgcacttcgctgtctgaggttctggattctcagtgtttgcgaagcgctgcatcatcctttggggaaggtaacaaaaaaagatatgcctgtttctttcttgcatggagctcatgtcatcttccatcacatgattgagagcaccgcattagaggcacatattttcattccttccacgtttacattgaatattttatcatgaatggatcatcaagggcatagccagaacccatctatgggggtggttggtagtggtgctcaattagcatatggttctaacccatatcagccaggccaaataactgggccaccggggtctgttgtgacatcagttggtaccattcaatccacacctgctggagctcagctaggacagcatcaacttgcttatcagcatattcatcagcaacaacaacaccagcttcagcaacagctccaacaattttggtcaaaccagtaccaagaaattgagaaggttactgatttcaagaaccacagtcttcccctggcaaggatcaagaagattatgaaggctgacgaggatgttaggatgatatcagccgaagcaccagtcatctttgcaagggcatgtgaaatgttcatattagagttaaccctgcgttcttggaatcacactgaagagaacaaaaggcgaacacttcaaaaaaatgatattgctgctgcaatcacaaggactgacatctttgatttcttggttgacattgtgcctcgtgaggacttgaaagatgaagtgcttgcatcaatcccaagaggaacaatgcctgttgcagggcctgctgatgcccttccatattgctacatgccgcctcagcatgcgtcccaagttggagctgctggtgttataatgggtaagcctgtgatggacccaaacatgtatgctcagcagtctcacccctacatggcaccacaaatgtggccacagccaccagaccaacgacagtcgtccccagaacattagctgatgtgtcgtggaaattaagataaccaggcaccggaatcagttgtgaatgtcaaactgaatggttgggaagatccatactacattgcgagcagaagctgtagctgatagtttacatgcaatgcagactataaacatatgtagataatgtgctagggaaaacttaaccttatctttgatttagctggataaaatggtatttttcatgtttaaatttacaggtcatcagatgataatatttatttactggtgaaaaaaaaaaaaaaaa

SEQ ID NO: 2460 - DNA, 1502 bp, Glycine max
  misc_feature: Ceres CLONE ID no. 573293
  misc_feature: Encodes the peptide sequence at SEQ ID NO. 818
  misc_feature: Encodes the peptide sequence at SEQ ID NO. 1931
atccctctcggtgctgtgtttagcttccttcttcttcttcctctttcttcttcttctgctgcacccacaaatcaaaaccccccttttccaacccaatttttctccataaaccctagattcaacgaacccgccgaccaagctcgaacctcacgtcgcaaaaaaacacttcttttcccctctccgaggttgtcgtgtcggagcatagccatgttgttccctcgaggaaattgatgatttttcataacattggggtctcgttttgcttgtggggtcaccttgaaggagggaaaagtaacgagctttggggctgaatcgtggtgggtctgttgagtatgcatagatctggagctacgatggcgtggaacgtgttcaagttctgcactgctctgcgtggattgggctcgatcatgatcctgttggttcttggcgttgttggtgccacttactatgctgttgttttgaccaattatggccctgctttgtatgctggaggacttgattctcttgttgccttggcagtgttgatcttgtttcatagcttgttggttatgctgttgtggagttacttttctgttgtttttaccgatccggggagtgtccctccaaactggaagcctacaattgatgaggaaaggggagaggctgatccgttggttgggacagagtttagtaatctgccgtctgatcccaatccacgggttcggtactgtcggaagtgcaatcagctcaagccgcctcgatgccatcattgttcagtttgtgggcgctgtgttttgaagatggaccaccattgtgtgtgggtagtcaactgtgtcggggctctaaattacaaatatttccttcttttcttgttctacacttttcttgagacgactctagtgactgcatccttgctgcctcatttcatagcattctttagtgatggagaaattcctggaacacctggctctcttgctacaacttttcttgctttcgttttaaacctggcctttgcactgagcgtcttaggatttctcatcatgcacatatctttggtggctgctaatacgaccactattgaggcatatgagaagaaaactactccaaaatggcgttatgaccttggtcgtcgaaaaaattttgagcaggtttttgggatggacaagaagtactggttcatccctgcttattcagacgaagatatacgaaagatgccagctctacaaggtcttgactatccttcaaaacctgacttcgattcccaatagttctaaaagctaatatatatccacatcatgtaacaaaagtcatggagactctccacaaccctctacttcactctctaacacaatgtagcgtggagcaatggggggcagggtggtgtgatgctggtttgaggggctaatgtgtttatgttcccataatgataggaactgttttttgtcaagcaatgcaattttctcacctttccttttattcaaattgagtgaaatagcaatttttagtgctggaatttattctct

SEQ ID NO: 2461 - DNA, 1281 bp, Glycine max
  misc_feature: Ceres CLONE ID no. 577178
  misc_feature: Encodes the peptide sequence at SEQ ID NO. 558
attacacctcacaaaatttctcacttcaactttgaacttcttttctctattattattatctttctctttttcttcatctcttatcttccttcacctttttattgaaagaaaaaaaaaatgagcaacataagcatggtagaggcaaagctgccaccaggattcaggtttcatccaagagatgaagagcttgtgtgtgattacttgatgaagaaggtgcaacacaatgattcccttctcttgatagatgttgaccttaacaagtgtgagccatgggatattcctgaaacagcatgcgttggagggaaggagtggtatttctacacacaaagagaccgtaagtatgcaacagggttacgcacaaatcgtgccactgcctcagggtattggaaggccacagggaaggacaggcctatcctccgcaagggcacccatgtagggatgaggaagactttggtgttctatcaaggaagggcacccaaagggagaaaaactgagtgggtcatgcatgagtttcgtatcgaaggacctcatggacctcctaaaatttcttcttccaaggaagattgggttttgtgtagggtgttctacaaaaacagtgaagttttagccaaacctagcatgggtagctgctatgaggacacgggatcttcaactcttcctgcgttaatggactcttacataagttttgaccaaactcaaacccatgcagatgagtttgagcaagtgccctgcttctccattttctctcagaaccaaacaaaccccattttcaaccacatgaccactatggagcctaagttccctctcaaccatgcaactacaacatatggaggagcaccaaatttgggttattgcttagaccctttatcttgtgacagaaaaatgttaaaagctgttttgaatcaaatcacaaagatggaaaggaatccacttaaccaaagtctaaaagggtcaccaagcttaggagaaggaagttcagagagttatttatctgaagtggggatgccccacgtgtggaattactgatgtgagactttagtacttaaaccctctcctccacctatgccaccatgaaatttttttttttaaaaaaaaaacaagaaaaaaaaaggtataagggggaagataaaatcaatccattgttttaagtcatggtgagtacttatgttttacctgtggtgttttagctattaatgtatacccatccatgatgtgtccctatatattaggaaaatgggacttgtaatttaaacttataaatatttgtagttaattttattt

SEQ ID NO: 2462 - DNA, 1251 bp, Glycine max
  misc_feature: Ceres CLONE ID no. 582684
  misc_feature: Encodes the peptide sequence at SEQ ID NO. 1072
gaatattcaatacctcctcttccaaaatatccacgtttcttttcccacacactatcttaaatcttaaaaacattttttttttcaaagcaattagaatttagaccacaaaaggaacaccgaagagatgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtccgtgtccgcctccggcggctgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaaaagagggggagaaaaaaattcaaagaagttatggaatttggaagatgatgaggaatgacgggggtgaggaactgaggatatgtaatttggctttgtgaatactaccaaatttgttatttgtttgttcaaaaaaaaaaaaaaaa

SEQ ID NO: 2463 - DNA, 809 bp, Glycine max
  misc_feature: Ceres CLONE ID no. 592713
  misc_feature: Encodes the peptide sequence at SEQ ID NO. 1643
  misc_feature: Encodes the peptide sequence at SEQ ID NO. 1758
aattaacaccaaaatcagaaacacaatcgtctccatcaccattcaaaacatggccaccacgatatcttgtgatttctcttcagtggaatctattcaacactatcttcttgagcttgaacacgatttcaacacactcatgaacgcttccaatcacgaaatttgctattctccaacgtacaattcattcccaagctctactacgttccgcttggaaggtgtccatgatgcagaagggtcgttagcatgcaaaagagaacaccctaaggtggagcgtgaatttcacgcgccaccagcatggaagcgttaccggggcgtgaggcgtagaccttggggcaagttcgcggcggaaataagagatccaaagaagaatggtgctaggatatggcttgggacttacgaaactgaagaagaagcgggtttagcttatgatagagctgcttttaagatgcgtggcagcaaagctaagttaaattttcctcacctcattggttctcacgcgcctctgaagccgataagagtattgacaaagactttgaagcaaaatttgttagagtctgatttgtcatactcatcggctccacagacgcaagagtcaaagaagagaaaaaatttgaccgacttgttgaacaggttggccaagaataggaaacaagtggaggtgtttgaaatgagtttacatgcatcaaatgatgtcaatgttgatcaatggtggagtaattaagttgaatgattgtgtccgggtgtaatgcatgtggtgcccataaggttctagtgttttccaaggactgtatacagttgtttgtttccct

SEQ ID NO: 2464 - DNA, 946 bp, Glycine max
  misc_feature: Ceres CLONE ID no. 596510
  misc_feature: Encodes the peptide sequence at SEQ ID NO. 2057
attcattttcttttataataccattcttttttctctttatctctttcatcaatacttcatcgttttcgttaagggatggcttctgccggctatgttttcaggcagggtttgccggaagtttgtgctgccgggaagttacacgtgcttgctgttgatgacagccacgtggaccgcaaggtcattgaacggttgctcaaaatctcgtcttgcaaagtgacggtggtggagagtggaagcagggctctgcagtatctggggttggatggagaaaaaagttccattggtcttgatagtgtgaaggttaatttgataatgacggattattccatgcccgggatgacaggatatgaattgctcaagaagataaaggagtcatctgtttttagagaggttccagtggtggttatgtcgtctgagaatatcttgaccagaattgatagttgcttggaggaaggagcagaggagtttctgttgaaacctgtcaagttgtcagatgtaaaacgcgtaacagatttcataatgagaggtgaagggatgaaaggagtaaaaatatctaaaaaaagaagccgatcagatgattgcattccatctctatcaactgcattctcatcagtttctcatccctgtgatatatcatcacctccatcgccaaccgaagaaatctagattgagcatatagattgagcagtgatgtatgtctcctccatttttgccaaaccattgttcatattcaaaagcctcagatgtaatttgcgtttttacactaaacattgctgacaacgagtactaggattaggaatgaggaagaggatgacagaatcattttgttctttagttcggtggcttacatattttttttgttcattctgatgctgtacagagaaagttcattaaattaatgaaaccctctattttgaggggtcttaccccaaaaaaaaaaaaaaaa

SEQ ID NO: 2465 - DNA, 779 bp, Glycine max
  misc_feature: Ceres CLONE ID no. 605218
  misc_feature: Encodes the peptide sequence at SEQ ID NO. 1882
  misc_feature: Encodes the peptide sequence at SEQ ID NO. 1753
aacacacacattggtgtttccaccaaatacagtgagcaaagttagctgaaaattaaaacatggtttccgccaccgtggattccgattttgcattcttggaatctgttcaacaatacctacttggacatgattccatcaatctcatgtctgaaacccaccaagctgcatctcatgatccattttcagaccctaataaatgtgatggtgattcagggaacattgctttccgaagtgaggatgcaacggctgtggtagcgcgtgatcatgcgccaccaacatggaagcattacagaggggtgaggcgtagaccgtggggaaagtttgcggccgagattagggatccaaagaagaacggagctagggtttggcttggcacgtatgataccgaagagaaggccgctttggcatatgacaaagccgctttcaaaatgcgaggccaaaaggccaagctgaattttcctcatcttattgattccgacaattccgatgaattgtcggagccagtaatgatgacaacttccaagcgaagtttgttagaaatttcatcaccgtcgtcctcgtgttcagatgatagctcagaatcacaagggacaaagaggaggaagagcctggctgaactactgaataaattagccaagaatagaagccaagtcaaggtggaatgttgaagtggctagaggaatatgcatgttgtacaatttgatcaatcattaatatgagacttcaacgattgtaatgtaatctggtgttcatagaattaatgcaattttgttcaccat

SEQ ID NO: 2466 - DNA, 550 bp, Glycine max
  misc_feature: Ceres CLONE ID no. 609713
  misc_feature: Encodes the peptide sequence at SEQ ID NO. 1809
aaacacactgaaaggaaaggccagatgtactgagcacaagaaagcaattaaattaacaaagagagctatatatatatatatatatatagctaaaacatctataatagtcatcatgtcagggcagagaaggtcgtcaagaacttcaaagttcactgagattgagattaatgaacttgtgtctaggttacaagttctgcttctgcaagtgaaccaaagaggcaactcaaggcaatcagcgtccaagatcttgcaggaaacctgctgttacattaggaagctgcaggaagaggtggaacagctcagtgagagactatcagagctcatggattctgtggatatcagtgacattgacagaagaactttacaaaaccttttgcaacaatattaacaaaatggccccttttctacagtgataaataccttgtctcccttatatatgtttgttcccccagtactgtagctaggttgtaatggagcctttcctaattttgtttttttttggaattatggagccttttcaagcatgcaataataacataccatatgttgg

SEQ ID NO: 2467 - DNA, 1277 bp, Glycine max
  misc_feature: Ceres CLONE ID no. 614500
  misc_feature: Encodes the peptide sequence at SEQ ID NO. 434
aaagttctgagtgctatttacttattgcattgccattgccaagtaatggcgctactacgtcttgtttgcttaacttcaacaaatcagttatcaactcaatccacctctttctcttttcttcgcaaaacaccccattctcaatacatccatatcaatccctcttcctttcactttccacgcctatcccttatcgcaaccactctcacacacgcccaacaacaaacccaacaagcggaccctgttgtcgccgaagaagaattttctcgcaccaggttactcgctcagaacgtgccctggacaagcacccccgaagatattcgctctttgttcgaaaaacatggaaaagtcctccaagtcgagctttctatgtataagaaaaacagaaaccggggtttggcctttgtcgaaatgggttccccagaagaagcacttgaagctctcaataatctcgaatcgtatgagtttgagggtcgtgtaatcaaagtcaattatgctcggccgaaaaaggagaaaacgccgccccctgtgaaaccaaaggtggtgacgtttaacttgtttgttgctaacttgtcctatgaagcgagcgccaaagatctcaaggagttttttgattctggaactggtaaagttgtgtctgctgaggttgtgtatcgtgataatcctagaaggccgtctggttatggatttgtgtcctacaagtccaagaaagaagctgaggctgctcttgctgagttccaaggaaagatttttatgggaaggccaatcagggtggatcggggtcggcgatttgttcaacaaccaggggacgggagtgcaaagtctgaagatacaccttctgatttgagtgtgaatggggcaaaagctcaacaacctgcagagggcagtgcaaagtctgaagatactccttctgagttgagcgtgaatggggaagaagctgacaaagttgattgatatcagtttttccctgatgcatatcaatattatttatgttgtatgtccttgcttcagacattctgaatgtttgctcatttttgcttacaatccaaagtctttgattggtttagattatgtgttttacaggtggttttcacctttatttaccagaggctcgtgagatacaaggagttgataggtgtaagcccaagcacttccgtgattcaagaatccatttatcttgattgcataatttgacaattgttggcaagctactatatcttaagaaagcgagaaatatatgtatatcagtggtgatgttgtttgcaaaaaaaaaaaaaaaa

SEQ ID NO: 2468 - DNA, 1065 bp, Triticum aestivum
  misc_feature: Ceres CLONE ID no. 617111
  misc_feature: Encodes the peptide sequence at SEQ ID NO. 1981
agcagcaaggaatcgagatccaatcacctcccctcccctccactcctcccccgcggcaagagagatccagccagatccgtccagttccatggcgaccgccggcaacgccccccgctcccgcaagcgcgtcgaggccaccgtcctcaagcgcgcgcgcgacggaagcgccttcacccgctgcgaggcgtgcaacaaggacgtagccatcgtcctcatcgacctgcacagctgcagcctcgactccaagatacgcctcagcctcgagtcgcaggtggtggagaaggccgtcgagatccaggagaagaagaggaagacgccctccgctgccgccggaggcaaggggaagaagaagagcaaggcagacggagatggtgccaagaagccaaaggcaaagcgcccaccaactgccttcttcctcttcatgaaggacttcagggttgagttcaaggcctctcaccctgacgagaagggtgttgccgccgttggcaaggcagcaggggagaagtggaaatccatgaccgaagaggagaagaagccctacaatgaccaggccaaggagctcaaggcccagtttgccaatggcgagggcagcgcggagaacaatgtgggagatgaggagaaggcagatgcggatgcagaggaggtggaggatgcggagcaggaggtggataagccagaagatgccccagaggacgaagaggaggaagaggagaagaacgagctggatgatgacatctagacggagctgaagaagggtgctcgttttcccgttttgtaaatggcaggtgttctatctgtcctgggcaacctgaatctcggcctaaactctaggagcagcagtagtgaatgttgtggctggttgcagtctgtttatcattgttatggaatggaaggaaagcagggttgatgtggtggtcgatgaatgactgaatctttctgtcactgcattgcatctgcaatatgtttgaaactagaattttgttaagatccagaagacaatataatctgctccaatactaggatattgatgttgttctacacaaaataaagatggatcaagaatag

SEQ ID NO: 2469 - DNA, 416 bp, Triticum aestivum
  misc_feature: Ceres CLONE ID no. 617713
  misc_feature: Encodes the peptide sequence at SEQ ID NO. 213
actcatcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggccgcggcggcggctacgg

SEQ ID NO: 2470 - DNA, 403 bp, Glycine max
  misc_feature: Ceres CLONE ID no. 624726
  misc_feature: Encodes the peptide sequence at SEQ ID NO. 1144
  misc_feature (332)..(332): n is a, c, t, g, unknown, or other
ggggagcaaaacctacagcttcacagaagaggacacaacctgccttggaagctaaagcagaagagtacaacaaaagagccaaaaagaaaggtttatctgtgtcccgagcccacctgcgtccatcatgatccttcaagggctttgggagacctcactgggatcaagaagcactactatcgcaagcacggtgagaagaaatggaagtgtgaaaagtgctcaaagaaatatgctgttcaatctgattggaaagcacattctaagacttgtggcactagagaatacagatgtgactgtggcactctcttctctaggcgtgacagtttcatcactcntmgggccttttgtgatgcgctagcmcaagagagtgcaagattcccgagtggcttaaactctctggggactc

SEQ ID NO: 2471 - DNA, 1193 bp, Glycine max
  misc_feature: Ceres CLONE ID no. 627169
  misc_feature: Encodes the peptide sequence at SEQ ID NO. 784
aacgttttatcctttcagctttaagctcaccgaactaactcagcattcaacaacaatggtgatgctcatccgttgctcttgcttcttcgctcgccctcgcttctcacaacctcaattctacggcaacaacaccaaacccttactcccagggaaattagcttttctttctctaaaacctgacaagggtgttccacactttgaagatacgcttgatgggtcttctaagatttcatgtttgctgcactgctcaaagtgtaaggaagacatacaccaaaggttcccatcactgatatttgttgcgagcaatgttttgatgttctctatgcctaacacagctttggctgaaacgtgtgaggctgataactctgttttcaatatgcctatactgctggcagtagcactcattggagccacagttggagggttgcttgctcgacaaagaaggaatgaattacagcgggtaaacgagcaattgatccaaatcaatgcagctttacggaagcaagccaaaattgagtcctatgcacctagtttgagttatgctcccattggtggtggtaggatacttgataatgaaattattgttgacccaaagaagcaagagctaatttctaagttgaaaaatggaaagaactttctaaggaatcaacaaccagataaagcattcacggagtttaagaatgcacttgagcttgcccagaatctgaaggatcctattgaagagaaaaaagctgctagaggcctaggagcctcactgcaaagacagggaaagtaccgagacgctattaaataccattctatggttttgggcatctcggaacgggaagaagaggactcaggcagtacagaagcatttggtgcaattgctgattgttacactgagcttggagagcttgagaaagcaggccaattctatgacaagtatattgcaagactggaaaaggactaatctttacaccgtttaacatttcttgaaagaaataaccagtgttggattactagactttcatcatggcttgtcaccatctgtttcatgcggattttccctttcctttctgatcctctctatggaacttcagattattcagttcctatttatttttaggttggaaatgctcaaagctatatgtatttccaagattgtgtaatgttagtcctttagacgagcaagggaaatatttgtgtttatcggc

SEQ ID NO: 2472 - DNA, 1695 bp, Triticum aestivum
  misc_feature: Ceres CLONE ID no. 630211
  misc_feature: Encodes the peptide sequence at SEQ ID NO. 930
aaaaccaccacccccgtgtcaaatcagatcatcgcacccccggagaatctgtccctcccgagaaagagacacgcagcgcagcgcaggggcgggcggaacaatggaggcgaacggcatcagcggcggcaccgccgaggccgcggctcgccgccctccgcacgtcgcgatgctggtgacgcccgggatgggccacctgatcccgctcgccgagctggccaagcgcctggccgcgcggcacggcgtcacggccacgctcatcaccttcgcctccacggcctccgccacgcagcgggccttcctcgcctccctcccgccgggcatctcctccctctccctcccgcccgtcgacctctccgacctgccgcccgacgcctccatcgagatgctcatgtccgaggagtgcgtgcggctggtgccggcgctcacggaggctctctcgcggctcatggagaccacgcggctggtcgcctacttcgccgacctcttcggggccgactccttcgacgccgccgtggccgccggcgtgcccaggaggtacctcttcttcccggggaacctccaggggctcacgctcatcctccacctcccggagctcgacgtctccatgcccggcgagttccgggacctggccgagcccgtcaggctccccggctgcgtgcccatcccgggggcggacatcctctcgccgctgcaggacaagtccagcccgagctaccggtggatggtgcaccacggcgcgcgctaccgcgaggcccacgccatcctggtcaactccttcgacgtcttggagccggacgccgccaaggtgctcggccgcccggagcccggccgcccgccggtgtacagcatcggtccgatcatacggaccgacgccgcgcccgtcgccaccgacgcgccgcgcgccgcgtgcctggactggctcgaccggcagccgccgaaatcagtgatcttcgtctcgttcggctccgggggatcgctgccaacggagcagatgcacgagctggcgctggggctggagctcagcgggcagcggttcctgtgtgtggtgcggagcccgagcgacgagggggccgtcaacgccaactactacgacgcggagagcaagaaggaccccctggcctacctcccggcggggttcgtggagaggaccaagggcgtcggcctccttgtgccgtcgtgggcgccgcagacggaggtgctggctcacgaggccacggggtgcttcctggtgcactgcgggtggaactcggtcctcgagagcctggtgcacggcgtgcccatggtcgcgtggccgctcttcgccgagcagcggcagaacgccgtgatgctctcgcagggcgtcggggccgccgtgcgggtgccggcgaccaagaaaaaggaggagatcgccgcggcggtgagggaggtgatggctggcccaggcaaaggcgccgaggtcagagctaaggtggcgacgctgcagaaggctgccattgaaggcctgctcgagggaggcgccgccatggccgcgctggacgaggtggcgagcaagtggacaggtgccgagcatgcatgactaggcgtcggcggatactttgccacctccaattctgttgtatgatttgttaagtaaaattctcatgcatgcactggttgtttgtaagttgcgttggaaatatttacggcagtcgattttgtccaaaaaaaaaaaaaaaa

SEQ ID NO: 2473 - DNA, 788 bp, Glycine max
  misc_feature: Ceres CLONE ID no. 630731
  misc_feature: Encodes the peptide sequence at SEQ ID NO. 1791
ctcatacacaacactcttctcttcttcctcctactcccctatatatctctcctcctccttccactaacaccatgtgttttatttcctactttccaacacaaccattagttcttaatttgtttcctcttgcttccttctccttctaaattattattactagtacaacttatcatatatatatatatatatatatmcctctggttatagcagcaaactaggctagcttagcttgcactttgaaaatatatatacacagaccaagtacaaccccaagctctagctagctagggacatgtctagccgaagatccagacaacattcagggtctacaaggatctccgatgaccaaatcatcgaacttgtttccaaattgcgccaacttgttcctgagattcgcaataggcgatctgacaaggtttcagcgtcgaaggtcctacaagagacctgcaactacatcagaagcttgcacagaraggtgagtgacttgagcgagcgactgtytcagttgttgaccmcaattgatgctgatagtgctgaagctggaatcattaggagcctacttaatcaatgagagtgttatgattttttttttttaattcaaagagggtgttgattaaattattattattattattattataagagtattgtacttcattctaggtgtgctgagagcctggggagagtgcagtttttgaggctgtacctcccatatggcaggtagggcattttcataactagttgcttttctcttcttttttttccaataaaaattaagtgcttgtacc

SEQ ID NO: 2474 - DNA, 1373 bp, Glycine max
  misc_feature: Ceres CLONE ID no. 630887
  misc_feature: Encodes the peptide sequence at SEQ ID NO. 809
aattaggctttggtcccatccaatcgcaaccaggaaatggatgtggttccttatccagtaacacccccaaacctcatttctctgccacatgaaccctcccaaacacagaaaccatagcaaaaagaaacccagattattgattattaataatggaagccatattcgtcaccaaacccgcttcccattctctcctcttaactaaactctctccgaatcccaaacacttgttccctccacaccaacaatcctttcacaacatccgccacaaacccacgcgcttccgccccgtcatcgctgttttccaaaaccaacatcaacaagatgcagctgcagcttccaaccacaccgaagatgagtcctacggcgaagtcaaaggcatcattggaagcagagccttggaagccgccaccggaatggagtacctcatcgagtggaacgacggccacgcgccgtcctgggttcccgccgacttcatagccaaagacgtcgtcgccgagtacgaaactccctggtggactgccgccaagaaagccgacgagtccgcgttgaaaaacttaatcgaatccgacgacggccgcgacgtcgacgccgttgacgccgacggccgcactgcgctcctcttcgtcgccggactcggctcggagtcctgcgtgaagctgctagcggaggccggcgctaatctggaccaccgagaccggagcggcggcctcgcggctctgcacatggcggcggggtacgtcaggcccggcgtggcgaaggttctcttggatctcggcgcggatcccgaggtggcggacgaccgcgggagaacggcgttggatctggcgagggagattctgaaggtgacgccgaaggggaatccgatgcagttcggacgcaggattggactggaaggtgtgattagggttttggaaggggcagtgttcgagtacgcggaggtgcaggagattctggaacggagaggaaagggtgagaatttggagtatcttgtgcggtggaaggacggtggtgccaacgagtgggtgaaggcgaagtttgtggcggaggatttggtgaaagactacgaggctggcctcgagtacgccgtcgctgaggcggtgctcgcgaaaagggtagcggatgaagggacgccggagtttttggttaaatgggccgatttggaggagcccacatgggagcccgaggagaatgtggacccagagcttgtcaaagctttcgagggaagtaacaaccaggcccagcccagtagtaatgggcccgctgtggtcttttccaatcaggatagccctagcctgtgatttttcatagtttgtttggactgggattttgttgcaaaatttcgggagcaaattaattaataattgttttgtacc

SEQ ID NO: 2475 - DNA, 955 bp, Triticum aestivum
  misc_feature: Ceres CLONE ID no. 631823
  misc_feature: Encodes the peptide sequence at SEQ ID NO. 1229
cactctctccctccccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccagcaagccctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactattgttttattgtattcgagccctaagatgtttgtgaagtaaacagctaaagagagtcctgttcaatttcgtaataagtgttg

SEQ ID NO: 2476 - DNA, 807 bp, Triticum aestivum
  misc_feature: Ceres CLONE ID no. 634261
  misc_feature: Encodes the peptide sequence at SEQ ID NO. 1496
aaccaaacgcaatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggcaccaatattgtgtgtaaacaactgcggcttcttcggtagcagcatgacaaacaacatgtgctccaagtgctacagggacttcattaaggccacgacaatggctgcccctgtagtggagaagaaggtgttctcagtggcatcatcttccagtgtgacattggagcaagcaaaggcagatgaagtaccagccgtggctgtagctgatagccaagcagcacaggagcctccaaagccgcccagcaacagatgcctttcatgccgcaagaagataggcttgaccggtttccagtgccggtgcgggggaacattctgctccatgcaccgctacgctgactcccacgaatgcactttcgactacaagaaggctggccgggagcagattgccaagcagaaccctgttgtgatagccaagaagatcaacaagatataattgataatgacaccgggttcatttgcttgctattcgtggtggtgctggattcgtctttacttgaatcagtaggtttcttctggtctggttgctagggtctcaattgtgtctatccttctccttcatggttcgcttctctccattaagaatgaaatgaaataatgtaaatatataatattatattgttttagctgttcgtttcgtatg

SEQ ID NO: 2477 - DNA, 1041 bp, Glycine max
  misc_feature: Ceres CLONE ID no. 636809
  misc_feature: Encodes the peptide sequence at SEQ ID NO. 1008
aaaaacagcaaaattagacatcgctcttctctctctctaaaaatctccggcggtccttcagtccattttcctttccatttcggatctgataggaatagatttcgtcagtgttgaaatcacgagaaattcatggctgctccaccggcaagagctcgtgcggattacgattatctcataaaacttctcttgattggcgatagtggtgtcggaaagagttgccttcttctacgattctctgatggttctttcacaactagtttcatcacaactataggcattgattttaagataagaaccattgagcaggatggaaaacggatcaagctccaaatttgggatactgcaggtcaggagcggttccgaacaattacaaccgcttactatcgtggtgctatgggcatattgctagtctatgacgttacagacgaatcttcatttaacaatatcaggaattggattcgtaacattgagcagcatgcttcagacaatgttaacaaagtactggtggggaacaaagctgacatggatgaaagcaaacgggttgtgcctacctccaagggccaagcactggccgatgagtatggaatcaaattctttgaaacaagtgcaaagacaaatctaaatgtggaggaagttttcttctctattgcaagagatataaaacaaaggcttgctgacactgactctaaggcagagccagcaggaattaaaatcaacaaccaactagatcatgcaacggctggggaagttgcacaaaagtcagcttgttgtgggtgaggaggcaacattattatccaagaacaagaaggaggaaaatacatgcatgatgataaattgatgatgattcgtgctttggattttacgcggtcattctttaatagtttctttcctagattaagttatatattaattcaaagttagatatgattgtgtcattgccccttgtgttgtttgtttgggcaacaaatctattgatcgttgatattttgaatggttaattgcattgatattctttaaaacgtaataaaattatattgaccc

SEQ ID NO: 2478 - DNA, 1477 bp, Glycine max
  misc_feature: Ceres CLONE ID no. 637282
  misc_feature: Encodes the peptide sequence at SEQ ID NO. 1491
attgccttcactttcaacccgtactttctctgtttctaaacaccccccacaaaattttctcactcgagaattttcccggaaaatctcacctttttcgatttctcagtcaagacaaacaacaacaaaaactctaaattctttcttaattcttgccaaattcgaaggagagagaaagagaaaaagaaaaggaaaaaaggttaatggcatcactgggatctccgtcttctttctggtgctaccgctgcaaccgcatagttagggttccacaaaaccacgccgttctcctctgccccgattgcaactccggcttcctcgaagagctccaaacccctccccactcgcgccgatccacgcgcggcggcggtgggtcccccttcaacccggtaatcgtcctgcgcaacgcaaacgacgtcgtctcgcccgaaacgcggaacttcgaactctactacaacgacgccgtttcaggttcctccggcccaagcagtctccgtcctttaccacagggagtatccgagttcctcatgggctccggcttcgacaatgtactcgaccatctcgacgccgccgcggggggcgccggagcactgccccccacggcagcgtcgaaagcggcgatcgagtcgatgccggtggttaagatcctcgcgagccacacctacgcggaatcgcactgcgcggtctgcatggagaatttcgagatcaactgcgacgcacgtgagatgccgtgcggtcacgtgtaccattccgagtgcatcgtgccgtggctctcggtgagaaactcgtgccccgtgtgccgccacgaggttccttcggatgaagttgaagaaagtaataacaatactgtggggttgactatttggagacttcctgggggaggattcgctgtgggcaggttcatcggagggagggagctcccactggtgtatacggagatggacggcgggtttaacggcgctaacggcgttccaaggagagtcgcttgggatagctccgttgggaggtctagggagaatagaggcttcggtgctgctttcaggaatgttttttcgtatatcgggagggttaggagctcgttttctcgccgaacgagaaattcgcgtgccaacggaagatctcgttcttaaacaacggtctgcaattgcaatttcgatcgtaacgtcaaggttattagagctcactgactgtgacgcggtcgcaattgatgctgcgctgtcctcaacatttttctgcaattttctacgatatcaaaggctgcggtgatgagaccgcaatcgcagattcgcagtaaggttttaagaaaaaacgtgattgcaattgacgtcacatcagctgcatttgtctgcaatttttctgttgtattcggaaacaatgacgagactgcaacttttttttaccacagtgggatttttcgatttttgtgatgtttttagtttgctaagtattcgtttgaatttttagaggaaatgcattttttttt

SEQ ID NO: 2479 - DNA, 458 bp, Glycine max
  misc_feature: Ceres CLONE ID no. 638126
  misc_feature: Encodes the peptide sequence at SEQ ID NO. 725
tttatcagtcatggcgtcaagctctctcagcaaacaaaaggcttctgactcctcttggacaccaaaacagaacaagctgtttgaaaaagcacttgcaaaatatgacaaggatacccctgaccgatggcagaatgtagccaaagcagtaggtggaaaatctgcagatgaagttaagagacactatgaaatcctcttggaggatctgagacacattgagtctggtcatgttcctcttcccaagtacaagtccacaggaagcagcaccaatgttgaggaagaagagaggcttctgaagtatcttaaactgaattgatggaagcaatgtttatgttatcctcagctattggcagaatttatgtggccatccttgaatctgcggaaatatcttccctctctgttctatttcctgccattgtaatttagattgtttcaaatttcaatgaattatcctattctag

SEQ ID NO: 2480 - DNA, 991 bp, Glycine max
  misc_feature: Ceres CLONE ID no. 638614
  misc_feature: Encodes the peptide sequence at SEQ ID NO. 1604
aaatcaacccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaattt

SEQ ID NO: 2481 - DNA, 953 bp, Glycine max
  misc_feature: Ceres CLONE ID no. 641329
  misc_feature: Encodes the peptide sequence at SEQ ID NO. 1452
aatttccctaggggcttaatatctccccgcatttgtgcctagcctcattattatcatagtagatattcattccccttatctttctctcttctctctccccgcccaaaccctaactccctaccctattccgctttctctcatccatcatgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattagagaatggactgatgataatagcatttatgtaggttctgatgattttgatcatccgtgtaggtggtctggtcatttccttataaacatatttctctttccaaaaaatatttccctgctcctccttccgtaaattgctcgtctttccaaaacgtgaatagtttaaagaagggagttctctttatttgtatttctaaatccaactgtttagttaagggatggttatctcttgtagagcttttagtttgatttagagttttcttgttgaaatctggttaagtttgtatcaatataattgacttatcatcccctttttgctgtatatatgcgatttatgttttttagttcctg

SEQ ID NO: 2482 - DNA, 1203 bp, Triticum aestivum
  misc_feature: Ceres CLONE ID no. 644344
  misc_feature: Encodes the peptide sequence at SEQ ID NO. 559
gatatccctctcggtagacggtacaatcataccgatcaggagccagctgctgcttcttgtgttgtgttggtcccactgccgagatcggcagcagaagcagccgtcggtcctctgtacctctcgttgatcgcttgatccgaggggatccgaggggatccaaggcgagctgcgtgcgtggtggcggcgatgagttcgctgagcatggtggaggcgaggctgccgccgggcttcaggttccacccacgggacgacgagctcgtgctcgactacctgtccaggaagctcggcggcggtggcgccggaggggcggcggccgcggtggcgagcatctacggctgccccgccatggtcgacgtcgacctcaacaagatcgagccctgggacctccccgaaatcgcatgcattggcggcaaggagtggtacttctacagcttaagggacaagaagtacgctacaggccagcgaacaaatagagcaactgaatcaggctactggaaggccacagggaaagaccgtgcgataagccggaaagggttgctagttggcatgagaaaaaccctggtgttttatgaaggtagagcccctaaagggaagaagactgaatgggtcatgcacgaattccgcaaggaagggcaaggcgatctgatgaagttgccactcaaggaggactgggtcttgtgtagggttttttacaagaccaggacaaccattgccaaaccatccacagggagcaactacaacattgacagtgcagccgcaacctcactgcctcctctcattgacaactacattgcctttgaccatcctggaatgtccacggtgcaaaacctagagggttatgagcaagtgccctgcttctccaatggcccctcctctcacccgtcgtcgtcggcctcgatgaacatcccggtgatggcgatggcgcccatggctgccgatcaggagcagcagcacatggggaaggcgatcaaggacgcgctgagccagctcaccaggtttgagcaaggcaacgtgaaaagggaggcgcctgcccagggtggtgtgtttgctcaagatgggttcgagtacttagctgagagtggcttttcacagatgtggaactcactcagttgattttctagctaggggtattattgctagtgctaccaatcaaagatctacattttctccacccgcaaaaataaagatctacattttcttgcg

SEQ ID NO: 2483 - DNA, 1230 bp, Triticum aestivum
  misc_feature: Ceres CLONE ID no. 644583
  misc_feature: Encodes the peptide sequence at SEQ ID NO. 99
aggttttactagggtttttgctagtttgcgccgtcgatcgccgccgacccccgccacccgccgacgcatccctccttcccggcacagcgtacgggccatgagagacctccacctcccgctgaaccagacccagagggtccgcctcgaggccgcgctccacgagctccagacccttgcccccgcggccgcgtccgccgccgccgtcaccgtcgcggacaacatccccgtcaaccacgaggacaacatcctcaaagggcatggtacgacggatcaggatggggaggtggtggcgacgctgtgcggcgtggtggagcgggtcaacaagctcgtctacgtgaggacgctccgggctaggtataagccagaggttggtgatatcatagttggccgtgtcatcgagattgctccaaagcgctggcggttggagataaactttagccaagatgctgttttaatgctttcttcaatgaatttgcctgatggaattcagagaagaagaactgcggttgatgagcttaatatgcggagtatatttgaagaaaatgatgtcgtctgcgctgaagttcgtggtttccaacatgatggatctcttcatctacaagcaaggagtcaaaaatatggaaagcttcagagaggtcaattgctcacggtgcctgcgtatctggtaaaacgccggaagctgcatttccatcatctagagcagtatgacgtcgacctgatccttggctgcaacggtttcatctgggtcggtgagcacgtcgtggtgcgtgaaattgctgatttgaaggaagacgaacagaagctgagcgccgaagcggagacttttaccccaatagaaacaaggagacacatttgccgtcttgccaatgctgcacgcttgctttcagccctaggattcactctgactgttgagctgataattcagactgcggaagcgagcgtatcatcaaatgtcgagataaacgacatgctcggggctgaattctatgtccagacggcggagggagaggctaagcgtcgaggtgacctcctgggaaagaagaggtaatcatcttggccctgcctgcctggtttgctgtaaactgaaaatgctgacatgtacgggatatgtaaaaggaggtaatgccacccggtgcccttgtagcatacgacgattttgagattttggagcttgctccactgtagtgtgcattcgttttaagatggtattaagatatctgttattctgtc

SEQ ID NO: 2484 - DNA, 728 bp, Glycine max
  misc_feature: Ceres CLONE ID no. 653656
  misc_feature: Encodes the peptide sequence at SEQ ID NO. 1792
  misc_feature: Encodes the peptide sequence at SEQ ID NO. 1818
acatgcaacttgtcttaatttctttctcgatccccaacatcactagctagctccttttgtacacactctacaaccccacctagctacatcacttaattagttttcccatatctataaccaatttcaaattctcacccttaactagctagctatatttcataactgattattaccaactcactacatattattggctaggattcaccattagacttaaaagtagttgatttattatatatataagatgtctagcaggaggtcacggtcaaggcaaacaagtagttcaaggaatatcaccgatgatcagatcaatgatcttgtctccaagttgcaacagcttcttccagagattcgcgataggcgctctgacaaggtttcagcttccaaggtgttgcaagagacatgcaactatattagaagcttacacagggaagtggatgacctaagcgagcgtttatctgagctcttggctacaactgacacagcacaagctgcaataattagaaatctactaatgcaatagatcggtgcagtagttaatttatcgcataattcatagttagcacttcagtacttgtgaaccgatccagtcagtagtcgcgtatttcttattctctttttgtttcactttttttttctggtttttgtccactaatatgcatgattactgcttttgcaaagcccattttcctaagatattaaataaaagtctgagtttgcgctttgct

SEQ ID NO: 2485 - DNA, 1201 bp, Glycine max
  misc_feature: Ceres CLONE ID no. 659211
  misc_feature: Encodes the peptide sequence at SEQ ID NO. 497
aatcatatgactcagcattccacacaatcatagaaagcaacgaaacgcaacacaacacatcgtaatacggcattccgttcattgtttctttcaactcaactcaactctctctcacccaccacaaaactagcagcaaaatttgaacaaactaccgaaacaaaaacaaaaccaaagcaaaaatcgttttttttttttctgttccctcatcctcatctattggattaactgattaatattattagggtcccttgtaaaaagaagattcttcatccttccacacaccccccacaactactgggagagaaaaaaggaaggaaattttgctattttctgagactcttgattttattttatttttatattttttctgctctgaagaagaaagatggaaatgatggcataccagtttactcggttaccttactcggattccctcaaactgctcgaggctgatatacagcatgcaaatgctttggctgctgcaattcccagagccaagggtgggactcttctccaaatgaaattggtttacaaccacttggctcctctctttctgttgttgctacagtggatgaaatgttcttgtacatgctttctacatagatatctcgacctcttccacatagttgtatacaaggtacacgatgatggtagatcaaatgtggcttctcatgggaggaaagcaagcatccgggacttttatgctgttatccttccatctctcgagcggcttcttggtagcttggagaagttggacatttgtaagaaaagtcattctagcatagatggtattagttatggcaagaaaatgatggaaggtgatgggaaactaatcaatatcgatctggaaagagaagatgaatgtggcatatgcttagagccttgcaccaaaatggttttgcctaattgctgtcatgccatgtgtatcaaatgctaccgcaagtggaacacaaggtcagaatcttgtcctttttgccgtggtagcttaaggagagttaattctgaggatctatgggtactcacttgtaatgaagatgttgttgatgctgaaacagtttccaaggaagacttgttgcgtttctacctttatatcaacagcctacctaaagatcaccctgatgcacttttcttaatgtattatgaatacctgatttgatattttttttactaaataaggagagaaaaaaattgtacagatagc

SEQ ID NO: 2486 - DNA, 1022 bp, Glycine max
  misc_feature: Ceres CLONE ID no. 659723
  misc_feature: Encodes the peptide sequence at SEQ ID NO. 2012
  misc_feature (576)..(576): n is a, c, t, g, unknown, or other
atttcccaatcaattccatccatcgggtctttactctcttacccaacccacacacactctttctctctctctctttccctgatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgnytgytcttgtgggggccmccgccagtggggtgccttactactacccgcccattggacagcctgccgggatgatgattggccgccccgccgtcgatcccgccaccggggtttatgtccagccgccctcccaggcatggcagtccgtytggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgtttactaaatttttatgggatgacactgtgaacctgttaactcgatgaacagcatgatttaactacttttgtacaaaaatttaaaactaaacactgatccttctgtgtgaaacatgtatgatcatctgccaawactgtttatttcct

SEQ ID NO: 2487 - DNA, 809 bp, Glycine max
  misc_feature: Ceres CLONE ID no. 661590
  misc_feature: Encodes the peptide sequence at SEQ ID NO. 1765
tcatttccgttctcaaaatcataacagtacttcgcgtgccctagctcactccgtcgctcctcacccttccggcagtgcttggtcgtggccgtcacggttcaaacttcaaaagttttgtagcatttgttgtgttggagtaggctatggatgacttgtttgattcttcgctgaacttggaggacacccattacaaggaaggctatgacgaaggctacagccatggccttgtcactggcaaggaagaagctaggcagcagagataagagatccaaagaaaaatggttctagggtttggctcggaacttatgttaacgaggaggaagcagctttggcttacgacaaagctgctttcaacatgcgtggccaaaaggctaagctgaattttcctcacctcattggctytgctgtgcagccggaaccaccgtgtctggcggtttytaagaggagcttaccagagtyttctcccccaacatcaccatatgatagttgtgagtcaaaagggtttaaraggaggaagagcctagttgatttgstcaataacttagccaagaacaaaagccaagccaaggtggtagaaatggccttggaggcaaatgaggttgagcaatgggtgaatgaattgaatgattgcactytattytggtgctcctagtgttgttgtgttttttctttttttaatttttgtttgtgtagttccaagttytttgtttttttgctgtgccaacaatgcagttcctaaataagtttgtaataatgatttttgcccmccacggaaraaattcaagtgctgattttaatttgktaacatt

SEQ ID NO: 2488 - DNA, 524 bp, Glycine max
  misc_feature: Ceres CLONE ID no. 663844
  misc_feature: Encodes the peptide sequence at SEQ ID NO. 1793
  misc_feature: Encodes the peptide sequence at SEQ ID NO. 1819
atgcattactacttgtcttgatttctttctcgatccccaacatcactagctagctccttgtacacactctacaaccccacctagctacatcacttaattagttttaccaatttcaaattctcacctgtcactagctatatttcataactgatcattaccaactcatcactacatattattggctaggattcaccattagacttaagattagttgatttattacatatataagatgtctagcaggaggtcacggtcaaggcaaacaagtagttcaaggaatatcaccgatgatcagatcaatgatcttgtctctaagttgcaacagcttcttccagagattcgcgataggcgctctgacaaggtttcagcttccaaggtgttgcaagagacatgcaactatattagaagcttacacagggaagtgggtgacctaagcgagcgtttatctgagctcctggatacaactgacacggctcaagctgcaataattagaaatttactgatgcaatagatcggtgcagttg

SEQ ID NO: 2489 - DNA, 1309 bp, Glycine max
  misc_feature: Ceres CLONE ID no. 670908
  misc_feature: Encodes the peptide sequence at SEQ ID NO. 433
attcagctattgtctattgcattgccattttcaagtaatggcgctactacgtcttgtttgcttaccttcaacaaatcaattatccactcaaccccattcccattcccaatccacctctttctcttttcttcgcaaaacgccccattctcaacccatcaatttcagtctctcttcctttcactttccacgcctatcccttatcacaaccaaacaaacccttaacctcactcccacacattcctccacttccgaacaacaaaccgaggagcctcttgtctctgaagaagaattttctcgcaccaggttgctcgctcagaacgtgccctggacaagcacccctgaagacattcgcaccctcttcgaaaaacatgggaaagtcctcgaagtcgagctttctatgtataagaaaaacagaaaccggggtttggcctttgtcgaaatgggttccccagaagaggcactggaagctctcaataatctcgaatcgtatgagtttgagggtcgtgtaattaaagtcaattatgctcggccaaaaaaggagaaaacagcgccgccccctgtgaaaccaaaggtggtgacgtttaacttgtttgttgctaacttatcctatgaagcaagctccaaagatcttaaggagttttttgatttgggaactggtagagttgtctctgctgaggttgtgtatcgtgataatcctagaaggccgtctggatatggatttgtgtccttcaagtctaagaaagaagctgaggctgctcttgctgagttccaaggaaaggtttttatgggaaggccaatcagggtggatcggggtcggcgttttgttcaacaaccaggggacgggagtgcaaagtctgaagatactccttctgagttgagtgtgaatggggcagaagctccacaaccagcagaggggagtgcaaagtctgaagatactccttctgagttgagtgtgaatggggaagaagctgacaaagctgattgatatcagtttttccctgatgcatatcgatattattgatgttgtatgtccttgcttcagacattttgaaagtttgctcattcttgcagataatccgaaatctttgattggtttagattatgtgttttactggtggttttcacccttatataccagaggcccttgagatacaaggagcggataggtgtaagcacaagcacttccgtgattcaagaatccatttatcttcattgcataatttaacaattgttggcaagctactatatcttaagaaagcgagaaatatatgtatatcagtggtgatgtttttcaaaaaaaaaaaaaaaa

SEQ ID NO: 2490 - DNA, 1419 bp, Glycine max
  misc_feature: Ceres CLONE ID no. 673567
  misc_feature: Encodes the peptide sequence at SEQ ID NO. 1110
atcatattcacatctccatctacacttccttcatttccatccccttctctcttttaaacctcacgcacaacgaaatcgtgattctgttgttcttttgaaatggaaaacgttccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattactaaaagtttaaataaaaggatcaattacagtgaatagtgaaattaaccccacttttgagctagaaggaagaggaaaaagaagagcctcggatgggattgatgctattgttgtttaatttctctgtatagattttatctaagacatgcatgtactgaagcatatgttgttaagtgtaagaaatgttgtggaatgaattaggctggtttggtctgttgacactttaggcttgtgcgtggctggcatgagcatgaacaaaaaaaaaaaaaaaa

SEQ ID NO: 2491 - DNA, 1197 bp, Glycine max
  misc_feature: Ceres CLONE ID no. 676378
  misc_feature: Encodes the peptide sequence at SEQ ID NO. 625
tttcttcattctttttctatataagctaaccttagcctcagttatctccttcttcttctttaccatagagccctttcttctcttctcccattttttcctctttcttcctcgcctagctagctccagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattcgtatgctgcactccttctccgtcgtgttcctctactggttctacgttttctcatgaactccctcttaaatccgtgattaattagatctatctccttagttaatccttgtcttttccaataattaattagatctgcgtctcctttttggattagtttcttttttggttctgttatcaaatcaaataaaaaatctccttctcggaaatggcatcaccgatccaacaacaacaacgctcgactactacaagttctggatctgaaggaggagatccgcatatcatcgatgagaggaagcggaagaggatgctgtcgaaccgcgagtcggcgcggcgatcgcggatgaggaagcagaaacagctggaggatctgaccgatgaagttagcagattgcaaagcgcgaacaagaagcttgcggagaacatagaggccaaggaagaagcgtgcgtcgagaccgaagcggcgaacagcattctgagagcacagacaatggaactggccgatcgattgcgcttcttgaactccatccttgagatcgctgaagaggtcgaagggttatccgttgagattcccgagattccagatcctctcctcaagccctggcagattcctcatccgatacaaccgattatggccaccgcaaacatgtttctgcgttgatcattcctgaggattttactttaattagggttattcagtgcggtagtaactttctctgttatgtgtattatattactattagtgttatctgtctgcatcaaaagtatcgtgtggtcatcaatgcattgggttcctgagagagatgaatgtgaggtacagggtgttgatggctggtagtggcagtgtgtgtccctttgcgcgacttgtaatcattttttatggtggctgttttattttaattaaaagtaatcccaaaaaaaaaaaaaaaa

SEQ ID NO: 2492 - DNA, 751 bp, Glycine max
  misc_feature: Ceres CLONE ID no. 676701
  misc_feature: Encodes the peptide sequence at SEQ ID NO. 426
aataggagcacacaaaaggagcatcgagtaggtttcctactcccttctcatcgttggcaagatgagtgccatgaaattttgccgtgaatgcaataacattctgtaccctaaggaagacagagaccagaaagttcttctcttcgcttgccgcaactgcgaccatcaggaggttgctgataacttctgtgtgtataggaatgagatacatcactctgttggagagcgcactcaggtgttgcaggatgtcgctgcagatccaacgcttcctcgaaccaagtctgttcgctgcagtcaatgcaatcatggtgaagctgtctttttccaggcaactgccagaggggaagaaggaatgacactttttttcgtttgctgcaacccaaactgtggacacagatggagagactgaaatttgtgcttcctcagatcaaaggttcaatattggggagatctaactatttgtggttatctgaaaaaacttggctgatgcggggacagtaatactgaagtatttgtgttacctgtttaactgcagttcctgatcaaataattaatacagttaatggacaaactgttgtttgccaatgctgataaattctgaggatgggcataaatttcatggtttgttaaaaggaaaaaggatgagtgacactgcttttatggatgggcctaactttcttggtggggagttaggaatcaaaatgacttttttttttgttatatgctatattatttgatgaaaaattcttattag

SEQ ID NO: 2493 - DNA, 1593 bp, Triticum aestivum
  misc_feature: Ceres CLONE ID no. 677386
  misc_feature: Encodes the peptide sequence at SEQ ID NO. 669
ctctcagtttctctctcacacacagctctctctctctctctctccttctctccctctctcaaatactccccatgcccatcgccgtcctcctttgaagaagccaatggccagcaatggcatggcgtcctctccctccgccttcttccctccgaatttcctcctccacatgcagcaagcaccaccgcagcatgacccccaagaacaccaccagcagcaccaccaccaccaccatgagcaccacctccctcctccccatccccagcacaaccccttcctcccctccccccaatgcccctccctccaggacttccgtggcggtctgtcgccaatgctggggaagcgcccggcgatgtacgggggcggcggcgacgggggctgcggcggcgacgaggtgaccggcggaggcgcgaacgaggaggagacgtcggacgacgggtcgcagctgggcggcgagaagaagcggcggctgaacgtggagcaggtgcggacgctggagaagaacttcgaggtggccaacaagctggagccggagcgcaagatgcagctggcccgcgcgctggggctgcagccgcggcaggtggccatctggttccagaaccgccgcgcccggtggaagacaaagcagctggagaaggactacgacgtgctcaagcgccagttcgacgccgtcaaggccgagaacgacgccctcctctcccacaacaagaagctccagtccgagatactgggactgaagggatgcagggaggcggcgtcggagctgatcaacctcaacaaggagacggaggcgtcctgcagcaaccgcagcgagaacagctccgagatcaacctcgacatctcgcgcacgccgccgtccgacggccccatggacgctccgccctcgcaccagcagggcggcgggggcgggggcatgatccccttctacccctccgtcgcgcgccccgcgggcgtcgacatcgaccatctcctccacgcctccgtccccaagatggagcaccaccacggcggccccgacacgcccagcttcggcaacctgctgtgcggcgtcgacgagccgccgccgttctggccgtgggcggatcaccagcagttcaactgatcgcccggtcggtcgatcgggacgatatatatctttgttgcagtcaatgacgtctgctttgcttgcatggtcagcaatgagcgtgcataaatattcgatgcgtttggattcttgatgaggacgtacgtacggtggagacggttgtacatgcatgtttgatgagaggcaagttcagttcatccatgaggtacctactgaagacgatggtgatgcgatttgagtcatggatcgatcgagttgatgatgaatagtggggctacgtgtaggggaataagtccggtgtgtgtgaagcgtgtgtaggtagattttggagttgaatagtacctacctttggtattcttattattttttcttgttttttcatttttcctcttccttttgttcccatacataaatttgtgaattgtgaggcggtgttgatccgttgttgtataggttaatggtgcatgtggtgcttattccccctatttatatatggattatgtgaagactgt

SEQ ID NO: 2494 - DNA, 1193 bp, Triticum aestivum
  misc_feature: Ceres CLONE ID no. 677852
  misc_feature: Encodes the peptide sequence at SEQ ID NO. 1490
aattcccctcccctctccaggtctcctcccgaaacccccaattcgaaaatcgatttggggatttcggcgtcccagatccgctcctccggccggttcgctcggccgcacgtccgatccgcgttcgcggccgccgtcggagctgctgaccggcccgcggctcgattcgtccgggggatttgttgcgggggctctcgcttgctcccgatggcgtcgtccccggtctcctactggtgctaccactgcagccgcttcgtgcgggtctccccggccaccgtcgtctgccccgactgcgacggcggcttcctcgagcagttcccgcagcctccgccgccgcgcggcggcggcggcagcggccggcgcggggccatgaacccggtgatcgtgctgcggggcggctcgctctccggcttcgagctctactacgaggacggctccggcgacgggctgcggccgctgcccggcgacgtctcgcacctcctcatggggtcggggttccaccgcctgctcgaccagttctcgaggctggaggctgccgccccgcgcccgccggcgtccaaggccgcggtggagtcgatgccgtccgtgacggtcgccgggggaggcggggcccactgcgcggtgtgccaggaggccttcgagcccggcgccgcggctcgggagatgccgtgcaagcacgtctaccaccaggactgcatcctcccctggctctccctccgcaactcctgccccatctgccgcagcgagcttccggcggcagccgtgcctgaggcggaggcggatgccgggctcaccatctggcgactcccccgcggcggattcgccgttggaaggttcgccggcgggcccagagagcaactgccggttgtctacacggagctggatggtggtttcagcaacggcgtcgggccgaggcgggtgacatggccagaaggagaagggcaggtggacggcggcgaaggtcggattcgccgtgtatttaggaacctgtttgggtgctttggccggggcggccggcctgagagttcctcgcagtcccgtagtggctgagcaatgttcttcctggtaactcactttcaattgatgatagtggtgaataagtaggagttagtataaggaggaaaccccaggtggtgagttattggttagtttgatgtaaatgaagggcttgcattccccaccttttgtctcgtttt

SEQ ID NO: 2495 - DNA, 1038 bp, Triticum aestivum
  misc_feature: Ceres CLONE ID no. 683923
  misc_feature: Encodes the peptide sequence at SEQ ID NO. 1023
accatttaacccccacgtcaaaaaaatcgatttcgccgtcctcctcgcctcgcccccgccccccgccccctccccccccagatccgccacagcccgcgccccgatccccgccccctcgtctgccggtcgggggatcagcacctgcgccgatcgaggggtaggaggaggaggaggaggaggaggaggaggaggaggcgggtgcgcgcgacatggctgcgccgccggcgagggcccgggccgactacgactacctcatcaagctcctcctcatcggggacagcggtgttggcaagagttgcctccttctgcggttctctgatggctccttcactacgagctttattaccacgatcggtattgactttaagatcagaacaatagagctggatcagaaacgtattaagctacaaatatgggacacggctggtcaagaacgtttccggactattaccactgcgtattaccgtggagccatgggtatcctgcttgtttatgacgtcaccgatgagtcatctttcaacaacataaggaactggatccggaacatcgagcagcatgcctctgacaatgtcaacaaaattttgattggcaacaaggctgatatggatgagagtaaaagggctgtacctactgcgaaggggcaagctttggctgatgaatacggcatcaagttctttgaaactagtgccaagacaaacctcaacgtggagcaagttttcttctccattgcccgcgacattaagcagaggcttgccgagaccgattccaagcctgaggacaagaccatcaagattaacaaggcagaaggcggcgacgccccggcagcttcggggtctgcctgctgtggctcttaagggacgagtcagtgtgtccgtgatcattgtttatttgacatcattcggttcctgctgcttgtctgttataggaagaatgtcaatcaagaagaaaattatgacttatgatacagatctggttgtacttatattcgcttcccattctttgaagcaactacccttgccgttaaaaaaaaaaaaaaaa

SEQ ID NO: 2496 - DNA, 880 bp, Triticum aestivum
  misc_feature: Ceres CLONE ID no. 686294
  misc_feature: Encodes the peptide sequence at SEQ ID NO. 1458
acatcccatctcccaccggcgaacccacccacgcaacccccaagcacacgcagcgcccgcctcctccccaccccacccctcgctccgatcccaaggttggcggccggcggcaggatgaaggccaaggcgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtggttggcaaggccggtggcgagaagtggaagtccctgagtgatgctgagaaggctccctacactgccaaggccgagaagctcaaggccgagtacaccaagaagatcaacgcctacaacaacccgcaggcaggagaggcgtccggcgactctgacaagtccaagtccgaggtgaacgatgaggacagcgagggcgacgagtgatacggcacaccgagcagctgcagcagggggagggggtctcttgaacgtggccgctgccgctcattgctggtgtcaccgatcgatgatggatgttcgctgttagtttagccccttggtagtccctccctctctttcaggttgctgctgctgatggcgatgatagaaatggtagctctagtccatgtagtcgttgtcctggaccggagtggtgaagttgctagcctagtttcctttctgcagggtcctctgctcggaccgccctctgttgcttcgtttttagtatgttttaattcagtctctgtcggatgtacctagtgtcgtgcccgtggctgttttaagaatcctgccccagatctcaatatatatggtgttgaaaggaagaaaatcatct

SEQ ID NO: 2497 - DNA, 780 bp, Triticum aestivum
  misc_feature: Ceres CLONE ID no. 686862
  misc_feature: Encodes the peptide sequence at SEQ ID NO. 424
gaaaggcgtcttcgtctcgacttgcttcccctccgagagaccgacctacccatccaatccatacactttcctgcaaagggtaggggatagacagggattctaaggctccgctccacaccaagagtagcgaagatctctgatttgagagagggaagcatcgaatcagccgacaggaggaggtctcagtcaccaacccagcagcagccatgagtgccatgaagttttgccgtgaatgcaacaacatcttgtatcccaaggaggaccgggaccagaaggtgctcctcttcgcctgcaggaactgcgaccaccaggaggttgcagacaacaactgtgtctaccgcaacgtggtgcaccacagcgctggagagttcacccaggtgctccaggacgtcgccggcgacccaacacttccccgcaccaaggaagtccggtgcgccgtctgtggtcacggcgaagctgtcttcttccaggccaccgcgagaggtgaggaggggatgacgctcttcttcgtctgctgcaacccgagctgcggtcatcggtggagagaatgatgtgtccatcacccaaccgatgacggatttcaccgatgcaacagtctgagagagttgttttttctttcttcccaagagatattttccccagtagcatgaattggctgtatgtttcagatgtattgaggcggcatatcattttcataactccatgaggaaaaaacaaccgcgtctaccggggtaaaaatatccctgtggtccattgcattaatcaaaggatgctacgagg

SEQ ID NO: 2498 - DNA, 1020 bp, Zea mays
  misc_feature: Ceres CLONE ID no. 689194
  misc_feature: Encodes the peptide sequence at SEQ ID NO. 909
gcgtgcggtcgtgtggaactgtagtgctggacatcctcgccttccagccttctcgaaaatcgaaaccctagaccgcgcgccccctcgccctccggccttccacgtccgatccgatccaaaatgcataagctaggcagaggaagccgggacaaggtgcaacagttcatggcaattaccggcgcaagtgagaaagctgcccttcaggctcttaaagctagtgattggcacttggaaggagcttttgatgttttctacagccagccacaaattgctgttgctaatactcgacatctggaagagctctacaacagatataaagaaccagatgctgatatgataatggtggaaggcatatcacagatctgcaatgatttacaggtggatcctcaggatattgttatgcttgtcatatcgtggcatatgaaagcttccactatgtgtgaattcactcgccaggagttcattggtggactgcagtcaataggagtggattcaatagagaagcttcaggcgaagttaccttcattgcgagctgagcttaaagatgatcagaagttccatgaaatatacaactttgcatttgcctgggcaagggagaagggccagaaatctctcgcattggagactgctattggcatgtggcagttgctatttgctgaaaggagctggcctctcattgactactggtgccaatttctacaggtaaggcataataaagcaatctccagggatacatgggcacagttattggagtttgttaagacaattgatcctcagctaaccaactatgacgaagaaggtgcttggccctacctaatcgatgaatttgtggactacttgaaagagaacggtcttgcctagcatagaaggtgtacggaattgggctgtaggggggagaatttgtcacccacaaggccaccatcattgtataacttaatggtcggatgcttgtattcattgcactaccaatagctaatgcggctcgtgcgtctggggatggagtttatcctctatatagac

SEQ ID NO: 2499 - DNA, 1037 bp, Zea mays
  misc_feature: Ceres CLONE ID no. 689414
  misc_feature: Encodes the peptide sequence at SEQ ID NO. 1037
aacctggtgctccgcccctcgccgttaccgcgacgcttcggcctctggctccaccgcctgcctccgtggctccgtgacgagacacgacgccgagaggtcacccccacaccgcgccgaggccaccccgcttgggattgtgaggtaaagcgtgatggcagcgccaccggcgagggcccgagccgactacgactacctcatcaaactgctcctcatcggtgacagcggagttggaaaaagttgtctcctgttacggttctcagatggatcattcaccactagctttattaccactattggcattgacttcaagataaggactgtcgagttggatggcaaacggattaagttgcagatctgggacactgcaggccaagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcgaaggggcaagctctcgctgacgaatacgggataaagttttttgaaacgagtgcaaagacaaacctgaatgtcgagcaggttttcttttccatagcaagggacatcaaacagagactttcggagaccgattccaagcctgaggatcgaactatcaagatcaaggctgaaggggaagctgaggcagcggcggcggcgcagaattcagcttgctgtggctcctgagcacttgtcaccgcaagatagtggcgttctcgcgcatgtaattttcatcgtttcattctttgccagcgactctctccttgtgcttcttgagctatcgcagttgctgtggcctggacaaatgggtgttaactgttaagtcagagcggttacttgctgtattgtgggaactctacccatggtaaggcgtgcataatggctgtgcaaagtacctttttacacgaaaaaaaaaaaaaaaaaa

SEQ ID NO: 2500 - DNA, 394 bp, Glycine max
  misc_feature: Ceres CLONE ID no. 690625
  misc_feature: Encodes the peptide sequence at SEQ ID NO. 594
agattatcttgaactcctctgatcagcagtctctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggtt

SEQ ID NO: 2501 - DNA, 765 bp, Triticum aestivum
  misc_feature: Ceres CLONE ID no. 699465
  misc_feature: Encodes the peptide sequence at SEQ ID NO. 1940
acatataaagcctcccgatttcgaacaccccatcgcatcccctccccccactcctcctctccttctcccccgatccgaacccattcccgcaccctcgcccctctccagacccgccggatctcgccgccaggaccgccgtccacccgcaaccaacgcaggcgaggcgatatggccaccttcgagctgtacaggcggtccaccatcggcatgtgcctcaccgagacgctcgacgagatggtctctagcggcacactcagccccgagctcgccatccaagtgctagtccagttcgataagtctatgacggaggcactggaaaaccaagtgaagagcaaggttactgtcaagggccatctgcacacctacaggttctgcgacaacgtgtggacgttcatcctgacggacgcgcagttcaagaacgaggagaccaccgagcaggtgggcaaggtgaagatcgtggcctgcgactccaagctactcagccaataagcagcgcgcgagctgctgactcccgaggcggggctccttcgatccccgcctccgctagagaagaacccccgccgccaccacacccccatcctcataatccatgggtacatgtagaaggatctcatgctatgcgatcctagagcatcgcattgcatcgcggccacagaactttttccgatccgtgtcgtgtaatgttgtttccggaacttttgatataactggtgactggaatgagtagcagcaatcaaaactttgtttggaaaaaaaaaaaaaaaa

SEQ ID NO: 2502 - DNA, 1045 bp, Triticum aestivum
  misc_feature: Ceres CLONE ID no. 701379
  misc_feature: Encodes the peptide sequence at SEQ ID NO. 1602
acaactttctctttctcttgcccactggttgctcctactctctgtagttcttcaggtgtgcaagaaagatatacgcacgtgagctctgattggcatggccgtggaggcggttcttgaagcggcaacgatgataccgtcgccgccgagcaaggagatggaggcgtctagtagtaccagcgaggaggcgtcggcgttgttggggcaggcggaggggtggtcgaagcggaagcggtcgaggcggcagcgcgcgctcgaccccagcgaggaggagtacctcgcgctctgcctcctcatgctggcgcacggccaccgcgacagcgcccctgctgccgcgccagagcagcagcacgggtgctccgtctgtggcaaggtgttcgcgtcctaccaggcgctcggcggccacaaggccagccaccggaagcctacagcggcgccggctggcgcagaggaccagaaaccgctggcggcggtggcggcagcttcctcgtcggggtccggcgaggccgcggtcagcgccggaggcggcaaggtgcacgagtgcaacgtgtgcaggaagacgttcccgactgggcaggcgctgggcggacacaagcggtgccactacgacggcaccatcggcagcgccgccgcagggcccacgcagaagctggccgccaaggcggccgcggcaagcgcgacggcggcgagccagggcttcgacctgaatctgccggcgctgccggacatcccggagcggtgcgcggtcacggaagatggggaggaggttctcagccccgcttccttcaagaagccgaggctcatgctcgcggcgtaaacccacagttacctgctgcatatacttggtcaaagtttagggtagaatctgctgattaattagttggtgtgcataactgttcatagcttgctggtgattagtgatgaccatcgattcattcgtgtatgtaagataggaactgtagtccattggtttgttcattgtaacatcaggattagacctagctaggtatgggctagctatcagctcgttagaaggattgattcttcc

SEQ ID NO: 2503 - DNA, 437 bp, Triticum aestivum
  misc_feature: Ceres CLONE ID no. 702924
  misc_feature: Encodes the peptide sequence at SEQ ID NO. 210
atcgctctcggggttggcttctcctccccttccggttcgggttctggttcggttctggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcsgcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggctacggaggcggcggcggctacggcggtggtggcgg

SEQ ID NO: 2504 - DNA, 1679 bp, Triticum aestivum
  misc_feature: Ceres CLONE ID no. 703017
  misc_feature: Encodes the peptide sequence at SEQ ID NO. 403
atttcttcttcgtcgagtttgggttggattaatccccgacccaaaccctaataatcgatctccctgacccgggactacgggccggggatcgatcgccatgcagcagaggatgaagcaggcggcggcggtagcggcgcagcagcagcagcagatgatgcagcaggctctgctcatgcaccagcaccagcagcagcagcaggcggcggccgcggtgccgcccatgttcccgccgcaccacgcgcacccgggtctccttgccgcgccgcatatagagcccatcgttagtgggaacctgcctcctgggtttgattcaagcacatgccgcagtgtgtatgttggcaacatccatcttcaagtcacagattcactactgcatgaagttttccagagtattggtccagttgaagggtgtaagctcatcaggaaagaaaagtcatcttttggttttgttgactattatgaccgtagatatgctgcacttgctattgtgtctctcaacggtagacaactgtttggccagccaataaaagtcaattgggcatacgcaagtacccagagagaggatacatcaggtcattttaacatcttcgtcggggatctttgccctgaggttacggatgctgctttgtttgcttttttctcggcatattctacctgttcagatgctagagttatgtgggatcagcagactggacgatccagagggtttggtttcgtttcttttaggaatcagcaggatgcacaaacttccataaatgaattgaatggaaagtggcttggcaaccgccaaattcgttgcaattgggcaacgaagggcgctaatgctggtgaagagaagcaaagtacagactccaagggtgtggtggagttgataaacggctcatcagaggctggcaaggagaatgcaaatgaagatggtcctgaaaataacccacagtatacaactgtttatgttggcaatcttccccatgatatcaacagcaatgatgtgcatcgatttttccatttacttggggctgggtcaattgaggaggtccgtgtaacacgcgataaaggatttggctttgtgagatatagtacccatgaagaagctgcacgagcaatacagacgggtaatggccaacttattggcgggaggcagatcaagtgctcttggggaagcaaaccaactccaccagggacagcatctgcgcctctgcctcctccggcattagcgccatacacccctggcgtgtcagcagttgacctcatctcctacgagcgatcccttgctctgagcaagatggctgccaacccggccctgatgggtcaggtcgccgccctgaggcaggccgcgatgggtatgggcaccggcgccagccaggccatctttgacgggagcttccagagtgtcaaccctcagcagcagcagcagcagcaacagcagcagcagstcatgtactactgagtgtatgaagcaagtatgctggcgacggaggggactacaacaccctccttcctaatatatatacatatatggtagatgaaccctctccagggccttttctttggttattactagtccaacatcgcaattagtaatttactatctctcgccgctgttaacgctccgggtcgccggctatatatagcaccaatgtactagaacatatgtatccctgacgtgttaagagttgggc

SEQ ID NO: 2505 - DNA, 128 bp, Triticum aestivum
  misc_feature: Ceres CLONE ID no. 703180
  misc_feature: Encodes the peptide sequence at SEQ ID NO. 1814
  misc_feature: Encodes the peptide sequence at SEQ ID NO. 1787
aatccaattccctcgctccaccgccgctccttctcggcccttccccgccccctcgcattgcagggaggagaggactcaatcaagatgccgaccatcatcatcaaggtggacctggattgcgcccgctg

SEQ ID NO: 2506 - DNA, 1942 bp, Triticum aestivum
  misc_feature: Ceres CLONE ID no. 703763
  misc_feature: Encodes the peptide sequence at SEQ ID NO. 954
ccggagctctcctcgctctgcacaaccatttttggttcgatcccggagaagctccggggctccttgaagcgatggatcagcgggcgaggcaccctcccggcatcggcaacggccgcggcgggaatcctaactaccacggccgtggcccgccgccgacgcagcagcatcaccagcagccgtcgccgccttcgccgcagcaggcgcaggggcacccgcagcagtacatgcagcggcagtcgcagcactcgcagcactcgcagcaccacagccagcagcttcagcatcagcagtggcttcggcggaatcagaccgctggcgaggccgcctcgggcgccgccagagccagcgagcaccacgcgccggctgccgccgatgacgccgatttgagttcgcaagactggaaggcccaattgaagcttccacctccagatacacgctaccagaccgaggatgtcactgcaactaagggaaacgaatttgaagactattttctgaagcgtgaacttcttatgggcatatatgagaaaggatttgaaagaccgtctcctatccaagaagaaagcattcctattgcattaaccggcagcgacattcttgcaagagcaaaaaatggaaccggcaagactgctgcattttgtatacctgcgctagagaagattgatcaagacaaaaatgctattcaagttgttatattggtccccacgagggaattggctttacaaacatcacaagtctgcaaggaacttgggaaacacttgaagattcaagtcatggtcactactggaggaacaagcctaaaggatgatattgtccgtctttatcaacctgtgcatttacttgtggggacgcctggtcgtgttttggaccttacgaagaaaggcatttgcattctgaatgactgttcaatgcttattatggatgaggcagacaagcttctttctcctgagttccaaccttccgtggagcagttaattcgataccttccatcgagtcgacagattctgatgttctctgcaacattccctgtgactgtcaaggctttcaaggacaaatatctgcctaaaccctatgttattaatcttatggacgaacttacactgaagggaattacccagttctacgcctttgttgaagaaaggcagaaagtccattgtctgaacactcttttttccaagctgcaaattaatcaatctataatattctgtaactccgtaaatcgtgttgaactactggcgaagaagatcacagagcttggttactcttgcttctacatccatgctaaaatgctgcaggatcatcgtaatagagtattccatgatttccgtaatggcgcatgcaggaaccttgtgtgtacagatctttttacaaggggaatagatatccaagctgttaatgttgttatcaattttgatttccccaagaccgctgaaacctatctccacagggttggtagatctgggagatttggccaccttggcctggctgtgaatctgatcacctacgaggatcgttttaacttgtatcggattgagcaggagcttggaactgagataaaacccatacctcctcagatagaccggacgatatactgccaatagttatctggaagattaatcttatatgccccaccctggaagttataagacaacttatgtaaatagcagctcatcaggtttcatttacgtgatctttatggtgtatcttaagttgttttggggtgctatgggacaggtgaaagtgtagctagctcgtctaatttccatcggaccacgtgggcggatgtatcatggctaagctaaaacttgccatcactgacaatagttaatgttgctaaccaggtgcctgttccgagactgttttccctaaaactgaaagatctctttttcttttgacaaatgtattggctggctagctttttgtacagggcatttttacactggta

SEQ ID NO: 2507 - DNA, 1210 bp, Triticum aestivum
  misc_feature: Ceres CLONE ID no. 704527
  misc_feature: Encodes the peptide sequence at SEQ ID NO. 791
ctacggccgcttagccaacgcgaggcgccgccggagacggcgatgcaggcggcggcctcttaccggggcgcggcaggccaccgccgcgccggccacccctcccggcgccctcccggtccctctcttcttctacccgtcagcgtcgctggcgtcggccgtttctccgacgcggcggttccgctccgagtcggctccctgccccttcctcgggctcgcggcggcggcgatttcgcgcggctggatgccagggacggggaggcgtggcagctgacgcgcgcgctcgggctaatccttcctggtcaccagaaaatggtgcatgctaacctgctgaaaactgctgttctttcaacaatgtcgatgctcataatgcctcttgaggcatcagcggagacatgtcaaccaactagttcttttgccaatatgccgattttcattgctgtcgctctaataggagctgctgtgggtggattattagcacggcaaagaaaggacgaactgaagcgattgaataatcaacttcgtcagattaatactgcccttagaaggcaggcacagattgaatcgtttgcccccggccttacttatgcgcctgtagggagagcaggagaaattgaggtcattgttgatcccaggaagcagcagttggtggtaaatttgaaaaatgggaagaattatatgaggaatcaggaccttgataaggcagtaatggagttcaagacagctctggagcttgcagaaagcataggggatcgctttgaggagaagaaagctgcgcgaggattaggcgcatcactacaaaggttgggacagtacagagaagcaatgagctggtactacaaggttctggcgctatcaaaggagaccggcgaggattctggctgcaccgaggcctacggcgcgatagccgactgctgcgtcgatctcggcgacttggaaggagcagcgaagctgtatgacgagtacatatcaaggctgcagccccgtgattgagcgctcggaccgttgttggagatcaaacacatcatatgccagagcccgtccgttgccctgcttctgatgtcgcggttgcttgcttgctatctggcggaaaacgagccgattttgcttgtcttttaacttggttggagcacttggattgtccatgaggagcccctctctacttgtgtatatgaatttcgatggtgctatggcatgtgctggttcagagttc

SEQ ID NO: 2508 - DNA, 1133 bp, Triticum aestivum
  misc_feature: Ceres CLONE ID no. 704938
  misc_feature: Encodes the peptide sequence at SEQ ID NO. 127
agatcacgcgccgctcctcccggtcgccctagcgccgccaccgaacgatcccccgaccccccagaccacgagaccacccgcggcggttggccggcgcagggatgggcgacgaggcgaagtacctggagactgcgcgggcggaccgctccgtgtggctcatgaagtgcccccccgtcgtctcccaggcctggcagggcgcctcctcctcctccggcgatgctaaccctaacccggtcgtcgccaaggtcgtgctgtccctcgaccccctcagctccgccgagccctccctccagttcaagatggagatgtctcaaactagtgtagccagcacttgcaatctaccaaagagttactccttgaatatgttcaaggattttgtacccatgtgtgttttctctgagactaatcagggaaaactctcatgtgaaggaaaagtcgagcataaattcgacatggaacctcacaaggataacttattaaactacgcgaagttatgccgtgaaagaacacaaaagtcgatggttaaaactagaaaagtgcaggtacttgataatgaccatggaatgagcatgagacccatgcctggcatggttggtctgatatcttctagttccaaggagaagaggaagccaacgccaaccaaaccatccgatgtcaaaaggacacgtagggaccgtcgggaactggaaaacattatcttcaagcttttcgaaaagcagcctaactgggcactgaaggctctagtgcaagagactgaccagccagagcaattcctcaaggagatattgaacgacctctgtatgtacaacaaacgaggtccgaaccagggcacgcacgagctcaagcccgagtacaagaagtcgtcggaggacgccgccggtgctgctccgtgaagacgatttgcgtatccgactgctgttgtataaccgagtacctgttggctttgatgtgcggaacgatgagttgtctatctgaagcctccgatcatgcctgggctgcatttgtttgctttttattaagaaggcactgttgtaactgtatgggtataagatgatacatatactgatatacaacacatgtcacagaagggaacgaatctactgataaaccacatgaaaagatcgtttgatttc

SEQ ID NO: 2509 - DNA, 1480 bp, Triticum aestivum
  misc_feature: Ceres CLONE ID no. 705041
  misc_feature: Encodes the peptide sequence at SEQ ID NO. 1960
acctacctactgcctccattcccaccacagctagcttcagcttttagctaagctctacttccctcccgagctaagcatcttcttgatttctcggtgatcggattcggatggacagcgcaagaagctgcctcgtggacgacgtgagcagcggcgcgtccacgggcaagaaggcctctccgtccccggccgcgccggcgaccaagccgctgcagcgcgtgggcagcggggccagcgcggtcatggacgcgccggagcccggcgccgaggcggactccggccgcgtcggcaggctgccgtcctccaagtacaagggcgtggtgccgcagcccaacgggcgctggggcgcgcagatctacgagcgccaccagcgcgtctggctcggcaccttcacgggggaggccgaggctgcgcgcgcctacgacgcggcggcgcagcgcttccgcggccgcgacgcagtcaccaacttccgctcgctcaccgagtccgacccggaggacgccgccgagctccgcttcctcgctgcccgctccaaggccgaggtcgtcgacatgctgcgcaagcacacctatcccgacgagctcgctcagtacaagcgcgcctacttcgccgccgctgcggcgtcctcccctacatcgtcctcggtgcctcccgcctcgtcgccctcttcggcggcttcgccctcgccggcggcgcggcgcgagcacctgttcgacaagacggtcacgcccagcgacgtggggaagctgaaccggcttgtgataccgaagcagcacgccgagaagcactttcctctccagcttccttccgccggcgccgccgtgtccggcgagtgcaagggcatgcttctcaacttcgacgactcggccggcaaggtgtggaggttccggtactcgtactggaacagcagccagagctacgtgctcaccaagggctggagccgctttgtcaaggagaagggcctgcacgccggcgacgccgtcgggttctaccgctctgcctcaggcagcaaccagctcttcatcgactgcaagctccggtccaagaccacgacgatgacgacgactttcgtcaacgcggcggccgccccgtcgccggcacccgtgatgaggaccgtgcgactcttcggcgtcgaccttctcacggcgccggcgccgagtcacgtgcccgagcacgaggactgcagcatggtgcccaagacaagcaagagatccatggacgccaacgcagcggccactccggcgcacgcggtctggaagaagcggtgcatagacttcgcgctgacctagccagctagcgtttttcctccatggttgctttgcttgcctccaaatttccatgttagtagcttagagctcttgatcggtccaagtgtttgccttttttttcctcttcttctcatacacaagttagctctaaatccagtcttctttaattaatctactgtaaattaagcccgttctcgaaatggcaagtgttcacc

SEQ ID NO: 2510 - DNA, 958 bp, Glycine max
  misc_feature: Ceres CLONE ID no. 707775
  misc_feature: Encodes the peptide sequence at SEQ ID NO. 1509
cattactttcaggtttcatttcaaaatattctctctctcctcttaaagcaaaacccttaattattaccaacgaccacacaccacagccactttcatcaatttccttaatccccacctccacataacaacaacaacgaactaacgccaccacattcattctttccttctttgtgcctacaatactactactactactactaattctacatggatggcaactcttttggaaacgtgccacccccaccaatacaagttcctgataacttggctatctcctcctcctcttcgccaactcccacgacatcatctccgtctccgacaccctctggaggctttcggtaccgcgggacgcggtgccggagcggaaagtgggtgtcggagataagggagccacgtaaaacgaatcgcatttggctggggacttacccgacagcggaaatggctgcggcggcatatgatgtcgccgcactcgcgttgaagggtcccgacacgcccgtcaacttccctaattcgatactgtcgtaccctattcctgcttcattgtcctccacggacattcgcgccgcggctgcggccgcggcgcaggctaggatcgtgagggcgccgcaggagagtgaggaaacggtaaaccctgatgatggcgggcaagggttatcggagaggcgtgaggagtacatttatgaggatgagttgttgaacatgccgaatttgctcgatgaaatggccagaggaatgcaggttagtccccttaggatcacttcctattcttcagatgattcgcctgggaattctgatggagataacctttggagttataccctttgatcactgatttgttgtttgttcagtgagtgagtatggtaatttgttttgtgtttgtttgaaagttcgagtcttgattatgtatgttcaaccttgttaaatatttgaaaggagggctttataacgggattgtggg

SEQ ID NO: 2511 - DNA, 1199 bp, Glycine max
  misc_feature: Ceres CLONE ID no. 709819
  misc_feature: Encodes the peptide sequence at SEQ ID NO. 1530
taccacaataatcaaagtctcaaccatgagaaaacgtatcaatatggaaagtgatgctgacttcaattcctttgccacatcctcctcttccaccacaccttcaatcttctttgacactaacacttctagcacatcctcctcctcaacatctcctacctcaaattcagaatcatgcaccaaagaacactccaaaacacctcaaaatgactcaaccacttctcaaacctcattggaaaatggaaaggactcaaaagggtgcaagaagaggcagatagacaatagcaaccagaatcaccaccctacttataggggtgtaaggatgaggaattggggcaaatgggtgtccgaaatccgtgagccgagaaagaagtcaagaatatggctaggaacataccctacagcagaaatggcagctagagcacatgatgtggctgccttagccatcaagggccattcagcatacctcaattttcctgaattggctcaagagcttccaaggccagttagcacatctcctaaggacattcaagctgcagctgcaaaagctgcaaatactgcctttgaggaggttaggcattgtcaaataactgaagaagaagcagaacaaaaccaagcagaacaagcttcatcttcaactctctcaatggacaatcctcaagagccttcaagttctcattctaccattgatgatgacactttgtttgaccttccagatcttttccctgatggaaacaatggactttgctccttttcttcttcttggcatttgtgtgcagttgatagtggctttaggcttgaggagtcatttttttatgagaaccattagaatttagaggctttttattttctttttaattcaagtaaaatacagagtttaataagaccaaaaggaaggagagcaacatgcggagtttttcttctttgtttggtcactgcaactgcattctgcgcagagaataaccagttgaggaagactttacatttttatctgtaaatggtgctgtctattgctaatattttgtccgatatagtttttttttctattttggggaataaaggtttaggtgagccgtgagcaaagactattccatcatcaagtaagttacgtattcaactaggagtgcataacatctgagacaaggtttctcttctactgtatatgaaaggtatttatgatttgagagaatatcctttcctct

SEQ ID NO: 2512 - DNA, 877 bp, Glycine max
  misc_feature: Ceres CLONE ID no. 721511
  misc_feature: Encodes the peptide sequence at SEQ ID NO. 1451
attattatcatagtagatattcattccccttatctttctctcttctctctccccgcccaaaccctaactccctaccctattccgctttctctcatccatcatgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattagagaatggactgatgataatagcatttatgtaggttctgatgattttgatcatccgtgtaggtggtctggtcatttccttataaacatatttctctttccaaaaaatatttccctgctcctccttccgtaaattgctcgtctttccaaaacgtgaatagtttaaagaagggagttctctttatttgtatttctaaatccaactgtttagttaagggatggttatctcttgtagagcttttagtttgatttagagttttcttgttgaaatctggttaagtttgtatcaatataattgacttatcaaaaaaaaaaaaaaaa

SEQ ID NO: 2513 - DNA, 1193 bp, Triticum aestivum
  misc_feature: Ceres CLONE ID no. 727056
  misc_feature: Encodes the peptide sequence at SEQ ID NO. 1996
agctcgcgagtcgctgccacatcacatctcgcctccgcctcctccctcctccctccctccccacaaacacccccggctcccgccgctgccgcgtcttctacccgtccagtcgccctccccgctgccgacttgtcgccgcagccgaagcacagcacagcacagcgcggaggcggagagaggtcgatccgagggcggagagagaggacgtagcgcgcggaggggagtgaggagggagggcgggatggagggcggacgatgactgcgcgcgccgcggcgggatgaggacgatctgcgatgtgtgcgagagcgcggtggcggtgctcttctgcgcggccgacgaggccgccctctgccgtccctgcgacgagaaggtacatatgtgtaacaagcttgctagtcggcatgtaagggttgggcttgcggaccctaataaattagtacgctgtgatatatgtgaaagttctcctgctttcttctactgtgacatagatggtacatcactttgcctgagttgtgatatggctgttcatgttggtgggaaacgaacccatggaagatacttgctgctaagacaacgagtcgaatttccaggagataaaccagggcatatggacgatgtagccatgcaacagatggagtctgaaaacccaagggaccaaaataatgctcattcggtagagaaggagcaaatggtgaaccaccaccacaatgcctatgatccggcctcagatggcaattgcaacggccagggtgccattgactcaaaaatgtttgatcttaatatgaggccagctcgtaataatgggcaaggttcaagttcccagactcatggagtggatcatagccacaacaacaaccatgactcttcaggagtggtcccaacatgcaattacgatggagccaccgacaagtaaacattggaatctcagaatgtaaattgcttcggttgctgttataaacatttcgtccgcaccgggagcttgaattagctttagccttagtggccaggctaaatgtatcgttgcagggaccttagaatgtgtgttgttttttaatagagacgaagctaacgactgtatctggattaagcatggcatgcactagacgctgtgctgcggatttctgttgtatgctatcgggaactgtacaaagaaataatagatctctcattttgtgtaaaaaaaaaaaaaaaa

SEQ ID NO: 2514 - DNA, 441 bp, Triticum aestivum
  misc_feature: Ceres CLONE ID no. 727529
  misc_feature: Encodes the peptide sequence at SEQ ID NO. 427
agaaaaggactgtcatctgcccgtcgacttgccagcaggaggaaatccaaccccgccgccgccgccatgagcgccatgaagttctgccgcgagtgcaacaacatcctgtaccccaaggaggagaaggagcggaaggtcctcctcttcgcctgccgcaactgcgagcaccaggaggtggcaggcgacaactgcgtctaccgcaacatcgtgcatcacgaggccggggagcgcacgcaggtcctgcaggacgtcgcttccgaccccacccttccccgcaccaaggacgtccgctgcgccgcctgcggccacggcgaggcagtcttcttccaggctacagcaagaggggaggaggggatgactctgttcttcgtgtgctgcaacccctcctgcggcaaccggtggagggagtgaatgaattcgcatctccttcctgcggaggct

SEQ ID NO: 2515 - DNA, 999 bp, Triticum aestivum
  misc_feature: Ceres CLONE ID no. 727613
  misc_feature: Encodes the peptide sequence at SEQ ID NO. 480
cagttggtctaaaatcgggctggcctgctggagcctggtcctctcccagcgcattgttgattgattcacgtcaagagcgagcgagacgccaagaactcggacggggaagtcgtgaggccgcctgcctccgcccgcccaggactcgatctcgatccccgccgacaagccgatcccccgtcctcctgcccgcgagagagaccggacgccgcgggagcgcccagatcccgccatgaatcccgagtatgattacctcttcaagcttttgcttattggagactcaggtgttggcaagtcatgtctgctgttaagatttgctgacgactcatacctggatagttacatcagtactattggagttgattttaaaatacggaccgtggagcaggacggaaagactatcaagttgcaaatctgggacactgctgggcaagaacgttttagaactattaccagcagctactaccgaggggcccatgggattattatcgtctatgatgtgacagaccaagatagcttcaacaatgtgaagcagtggctcaacgagattgaccgctatgccagtgagaatgtgaacaagcttctcgtggggaacaaatgtgatctggctgacaaaagagctgtgtcatatgaaacagcaaaggcatttgctgatgagattggcattccattcatggagaccagtgcaaagaacgccctgaatgttgaacaggccttcatggccatggctgcttcgatcaaggataggatggcgagccagccagccgcaaacaacgctcgcccagctactgtacagatccgcgggcaacctgtcgagcagaaggccagctgttgctcttcttagaaaaccatgcaaacttgttgatgctccgtcacctttatacatgttttcttatttgtttttacttgttatctttattcttttctttctagtgtacctgccttctgaaattgtgtaacttggatgaatatatatcttcttacataaaaaaaaaaaaaaaa

SEQ ID NO: 2516 - DNA, 415 bp, Triticum aestivum
  misc_feature: Ceres CLONE ID no. 731572
  misc_feature: Encodes the peptide sequence at SEQ ID NO. 215
  misc_feature (398)..(398): n is a, c, t, g, unknown, or other
atcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagcycgacgggcgcaacatcaccgtcaacgaggcccagtcccgccggtccggcggtgggggcggncggcggcggctacggcg

SEQ ID NO: 2517 - DNA, 986 bp, Triticum aestivum
  misc_feature: Ceres CLONE ID no. 737259
  misc_feature: Encodes the peptide sequence at SEQ ID NO. 211
  misc_feature (158)..(158): n is a, c, t, g, unknown, or other
catcctaatcgaaaataatcgaaaatctmatcgctctcrrggttggcttctcctccccytccggttcgggttctggttcggttckggtccgagagtagctagcctagtctagggtttccgtagagaggaagggagagggagatccatccatggcgganacggagtaccgctgcttcgtgggcggcctcgcctgggccaccgacgacwacarcctccagcaggccttcagccagwrcggcgagatcctcgacgccaagatcatcaacgaccgcgagacggggaggtcccgcgggttcggcttcgtcacgytcggcagcgaggartcgatgcgccaggccatcgaggagatgaacggcaaggagcycgacrggcgcaacatcaccgtcaacgaggcccagtcccgccgctcgggcggagggggcggcggcggcggcggctacggcggccagcgcggcggtggcggaggctacggcggcggcggcggctacggaggcggcggcggcggctacggcggccagggcggtggcggctacggcggccagcgcggtggcggcggcggctacggcggcggcggcggctacggcggtggtggcggctacggcggccagcgcggcggtggcggcggcgactccggcggccagtggaggaactgagcctcgaatctcccagttatcgatctatctaccgtgtcgtcgtcgtcgtcttcgttagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgttactatctttcagtcggtcggtcggtcggtcagtcggtgatgcagcaatccccttctgtcatggattgggatgtgatgttggaatatcctatgtttgaacaagtttaaatggatgaagaaaatgcaagtcatagctgcg

SEQ ID NO: 2518 - DNA, 415 bp, Triticum aestivum
  misc_feature: Ceres CLONE ID no. 738726
  misc_feature: Encodes the peptide sequence at SEQ ID NO. 1232
caagcttggtctgcactccctgcgccagcggcactggtacattcagagcacttgcgcgacgtctggcgaagggttgtacgagggtcttgactggctctccaacaacattgccaacaaggcttgaagcgcctcgacaagcgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtctttttttgcatggatgttatcagttgctgttcggtggttttacaaggtttaatgtgtcgacaatgtgtgtctgaacccctatcgttttgagttttagcaagattgaattgtggttgcct

SEQ ID NO: 2519 - DNA, 486 bp, Triticum aestivum
  misc_feature: Ceres CLONE ID no. 741793
  misc_feature: Encodes the peptide sequence at SEQ ID NO. 204
atcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggtggctacggcggccagggcggtggcggctacggccagggaggcggtggcggctacggccagggcggtggtggctacggcg

SEQ ID NO: 2520 - DNA, 899 bp, Triticum aestivum
  misc_feature: Ceres CLONE ID no. 749118
  misc_feature: Encodes the peptide sequence at SEQ ID NO. 657
acagttcgggccttagcccctctcgtcgacagcgtcgtcctctcaggcgcaggcgcagccggacttcgattacctgttcaagctcctcctcatcggcgactccggcgtcggcaagagcagtctcctcctccgattcacatccgactcattcgaggacctatccccaaccatcggcgtggacttcaaggtgaagatggttaacattgccggcaagaagctcaagctcgccgtctgggacaccgctggacaggaacggtttaggaccttgaccagctcttactacagaggggcacaagggatcatcatgggtatgtacgatgttactcgccgagaaacattcaccaatctctctgacatatgggccaaggaaattgacctgtattcgaccaaccaggactgtataaagatgcttgtcggaaacaaagtggacaaggaaagtgagagggctgtcaccaagaaggaaggcattgactttgccagggagtatgggtgtttatttctggaatgcagtgcgaaaaccaaagtgaacgtggagcagtgctttgaggagcttgtgctcaagatattggacacgccgagcctgttggcggatgcatcctctggggcgaagaagaacatcttcaagcagaaggcgccagaggctgatgctgcggcgagcggctgctgttgatttcattcacgcatgctaatcccggacatctatctatgatctatcttagtggaggatggatgacaacgtttgttggagaaagtgatgatatctaggcagcttgtttgtttctgccggttttatttcgcttttgtgttgctgtatatgaatcagtcagtcggtcggtcgctcaatgctcctcatgttgaagttgaatctgaaaacaaaacacacaaaaaaaaaaaaaaaa

SEQ ID NO: 2521 - DNA, 423 bp, Triticum aestivum
  misc_feature: Ceres CLONE ID no. 751438
  misc_feature: Encodes the peptide sequence at SEQ ID NO. 202
aaaccttagacgcgaacgcacctcctcccctcctgcccccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggc

SEQ ID NO: 2522 - DNA, 509 bp, Triticum aestivum
  misc_feature: Ceres CLONE ID no. 751992
  misc_feature: Encodes the peptide sequence at SEQ ID NO. 1438
ctagagaaaaggctggaatcgcaggaatggtgcagctaaacacattgggatatccacttcgaccgaattgaaaggggagtgtgcatactacttaaaaacaggacagtgtaaatatgggaatacatgtaaatttaaccatccagaaattttcaatgcggtggcttcttcacgtggttcccctatttatcctcctgtacataactctggaagcactggtccacattcctatactggaacaatggcaagctggacttatccaagaggttctttcattccaagccctagatggcaaagtccttcaaactatacaccgatgattgtaccacagggtcttgttcaagtaccaagctggaactcatatcctggccaaatggtacctgtttcatctcctgagagtcgactacagtctccaggggctcaacaatactatggaacttctcgacaaggtgaagccagcgcaggaaatcagggaatgcaatcatcctacagatccagttcgtttcctgcac

SEQ ID NO: 2523 - DNA, 454 bp, Triticum aestivum
  misc_feature: Ceres CLONE ID no. 754335
  misc_feature: Encodes the peptide sequence at SEQ ID NO. 205
ctcatcgctctcggggttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcgg

SEQ ID NO: 2524 - DNA, 499 bp, Triticum aestivum
  misc_feature: Ceres CLONE ID no. 756168
  misc_feature: Encodes the peptide sequence at SEQ ID NO. 214
atcgctctcggggttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggcgactccggcggccagtggaggaactgagcggcggggccctccagttatcgatctatctaccatctcgt

SEQ ID NO: 2525 - DNA, 401 bp, Triticum aestivum
  misc_feature: Ceres CLONE ID no. 758560
  misc_feature: Encodes the peptide sequence at SEQ ID NO. 208
atcgctctcggggttggcttctcctccccttccggttcgggttctggttcggttctggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgccgacccataccggaacaggaggg

SEQ ID NO: 2526 - DNA, 463 bp, Triticum aestivum
  misc_feature: Ceres CLONE ID no. 761865
  misc_feature: Encodes the peptide sequence at SEQ ID NO. 206
  misc_feature (433)..(433): n is a, c, t, g, unknown, or other
actcatcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtngcggaggctacggcggcggcggcggtggct

SEQ ID NO: 2527 - DNA, 1438 bp, Triticum aestivum
  misc_feature: Ceres CLONE ID no. 763852
  misc_feature: Encodes the peptide sequence at SEQ ID NO. 1655
acaccacacaccatcaccactgctagctactcctactcgatcgatcgtcccagcttttgccacagacagcaagagcctaacacgttttccacccagcagcagcagcagctaggatggccatgaatcctctctcccaggagcaccccaatgcatggccatggggcgtggccatgtacacgaacctgcactaccagcagtaccactacgagaaggagcacctgtttgagaaggccctcacgcccagcgatgtaggcaagctcaacaggctggtgatccccaagcagcacgccgagaggtgcttccctcttggcggcgactctggggagaagggcctgctcctctccttcgacgacgaggccggcaagccatggcggttccggtactcgtactggacgagcagccagagctacgtgctcaccaagggctggagccggtacgtcaaggagaagcatctggaagccggcgacgtcgtgcacttcgagagggtgcgcggcctcggcaccggcgaccgtctcttcatcggctgcaggcgtcgcggcgacgtcagtgcaccaacggcagtggcaccaccgcctgccgtgcatgtcgtgccagcgtctggtcagagtcccagggagcagcagcagcaccagcagccatggagcccgatgtgctacagcacatccacctcataccctactagcccggccacctcccacgcctaccgtcgctcagcagagcacgatcacagcgacatgcatcatgcaggagaatcccagtgggacgcagacaccaggagctgcagcccagcctcggcaccgacacgccggctcaggctgttcggcgtgaacctcgactgcgcgccagagccagaggcagaagccgtgcccgcgacgccggcgatgtacggctacgtgcaccagagcccctacgccgccgtgtctccagttcccagcaactggggcagttcatgaagaagatgacgaggagatctgatgccatgcctttctttgcatgagctgaacaaccagcggtggaacaagtttactaccaccaccagcagcagcctactactgctgctatgcaccaagtgacaggtttgaattgacccgtggaaggaaaagagaggaagtggggagatcccttgttccccagtcaatcttccatccacccatccacccatccattcatcgccccttttctttttcttcttttcccccctttttgtcttccagaaacaccatttgatgtacggcggcaggcatgggttaggggaggattcaggaaaaagagagggggagagagagctagacagagagacagacttgtgtacgtatgtgtcatgtctgtaagtgagtgcttcagtgggggccaagaagaacctctgaagctgatgtatcctctcctgcctgctcaagaaacatccccattgggattttgtacaaaaaaaaaaaaaaaa

SEQ ID NO: 2528 - DNA, 1246 bp, Triticum aestivum
  misc_feature: Ceres CLONE ID no. 764678
  misc_feature: Encodes the peptide sequence at SEQ ID NO. 1948
gagcccatcgacagtccaatccccccaccctcgtcgccggcgccggctccggcgaaaaccctagcgagctatggagaggcccggccacggcggcatcggcagcggcggcggcagcaagaacccgccgccctctgggaaggatgagtacgggggagggtacgaccggcttgacgaggaggtggagttccggctgccgagggggcaccggccggtggagaacctggacacggaggggctggagcaggcctccgtcgacacgcgcctcgcctcctccaacgtcggcttcaggctgctgcagaagatgggatggaagtccggcaagggcctcggcaagaacgagcaaggtatactagagccaataaaagctggtatcagggatgcaaaattaggagtgggaaagcaagaggaggatgacttcttcacagctgaggacaatgtacaaagaaagagattaaatgttgaacttgaggagaccgaagagcatattaagaagcgtgaggtcacagcagaacgtgagcagaaaatccgcagtgaggttaaggagatacagaagaccttcttttgcagcctctgtaataagcaatacaagctggcatatgaatttgagagtcacctaagctcatatgaccataatcataggaagaggtttaaggaaatgaaagaaatgcaaagcggcggcagtggcaaccgtgatgataggcagaaacgtgagcagcagcgagaagagaaggagctggcaaaatttgcccaactggcagatgctcatagaaagcagcagaaagagaagcaagaacaaccagatatctcaggagagcaagctacgtcaaagaacttgcctaccccgggcaaccaggatcagcgtcgaacattgaagtttggcttctccaaaatgaccccttccaaggcacctgttggcagcatgagcaagaagccaaagattgcgacgaaagtcccttccgtcttcggaaacgacagcgacgaggaggcgtgatcttcctttgccgtgacatgatacctcacaaaggaggggaatgccggccttgtcagcagattcgaccctgagaagatgccatggatgtaatgtgccgctggtttgaccagatgcggattgatagcggcatcttggccaaccccgtgaacaaacggggacttggacgacgctgcggcgttaattgtgttgaactgatggtacattgtaagagcaactctgtctgtctgtaaaaaaaaaataaaaaaaaaaaaaaaa

SEQ ID NO: 2529 - DNA, 2140 bp, Triticum aestivum
  misc_feature: Ceres CLONE ID no. 777111
  misc_feature: Encodes the peptide sequence at SEQ ID NO. 955
accgaccaacgcccctcgagtcgtcgctccaaatcatagcattccggccggatctatccgacgagcgaagagtcttcgctctgcacaaccatttttggctcgattccggagaaggtccggggctccttgaagcgatggatcagcgggcgaggtaccctcccggcatcggcaacggccgcggcgggaatcctaactaccacggccgtggcccgccgccgacgcagcagcatcagcatcagcagcagcagcaggcgcaggggcaccagcagcagcacatggagcggcagtcgcagcgctcgcagcaccacaaccagcagcttcagcatcagcagtggcttcggcggaatcagaccgctagcgaggccgccgcgggcgccgccaaagccagcgagcaccacgcgccggctgccgccgatgacgccgatttgagtccgcaagactggaaggcccaattgaagcttccacctccagatacacgctaccagaccgaggatgtcactgcaactaaaggaaatgaatttgaagactattttctgaagcgtgaacttcttatgggcatatatgagaaaggatttgaaagaccgtctcctatccaagaagaaagcattcctattgcattaaccggcagcgacattcttgcaagagcaaaaaatggaacaggcaagactgctgcattttgtatacctgcgctagagaagattgatcaagacaaaaatgctattcaagttgttattttggtccccacgagggaattggctttacaaacatcacaagtctgcaaggaacttgggaaacacttgaagattcaagtcatggtcactactggaggaacaagcctaaaggatgatattgtccgtctttatcaacctgtgcatttacttgtggggacgcctggtcgtgttttggaccttacaaagaaaggcatttgcattctgaaggactgttcaatgcttattatggatgaggcagacaagcttctttctcctgagttccaaccttccgtggagcacttaattcgataccttccatcgagtcgacagattctaatgttctctgcaacattccctgtgactgtcaaggctttcaaggacaaatatctgcctaaaccctatgttattaatcttatggacgaacttacactgaagggaattacccagttctacgcctttgttgaagaaaggcagaaagtccattgtctgaacactcttttttccaagctgcaaattaatcagtctataatattctgtaactctgtaaatcgtgttgaactactggcgaagaagatcacagagcttggttactcttgcttctacatccatgctaaaatgctgcaggatcatcgtaatagagtattccatgatttccgtaatggtgcctgcaggaaccttgtgtgtacagatctttttacaaggggaatagatatccaagctgttaatgttgtcatcaattttgatttccccaagaccgctgaaacctatctccacagggttggtagatctgggagatttggccaccttggcctggctgtgaatctgatcacctatgaggatcggtttaacttgtatcggattgagcaggagcttggaactgagataaaacccatacctcctcagatagaccggacgatatactgccaatagttatctggcagattaatcttgtatgccccaccctggaagttataagacaacttgtgtaaatagcagctcatcaggtttcatttacgtgatctttatggtgtatcttaagttgttttggggcgctctgggacaggtgaaagtgtagctagctcgtctaatttccagcggaccatgtgtgtggatgtatcatggctaagctaaaacttcccgtcactctgacaatagttaatgttgctaaccaggtgcctgttctgagactgttctctctaaaactgaaagacctccttttcttttgacaatgtattggctggctagctttttctacaggacattttgaccctggtatttctgtgagttgcgtgaccttggcgtgcacagatggatcactccacctgggccaagctgtcgcgatgtatgtgtatggaccacacattttgattattttgtatttgtatccattctgatgtgccatatttgtaactgcaaaaaaaaaaaaaaaa

SEQ ID NO: 2530 - DNA, 62 bp, Glycine max
  misc_feature: Ceres CLONE ID no. 782784
  misc_feature: Encodes the peptide sequence at SEQ ID NO. 1453
  misc_feature (40)..(40): n is a, c, t, g, unknown, or other
ttttagtttgatttagagttttcttgttgaaatctggttnagtttgtatcaatataattgac

SEQ ID NO: 2531 - DNA, 1593 bp, Triticum aestivum
  misc_feature: Ceres CLONE ID no. 783774
  misc_feature: Encodes the peptide sequence at SEQ ID NO. 1968
agccagcggcacaagtccacccccaaatccacacggaacagggcaaaccctctccccatggaccagccgaagccgacgccgtcggcggccgcctcgccggcgggggcggacgcggcgcccaacccctacgccttcacgtgcgagctcccccactcgatctacgcgctggccttctccccctccgcgcccgtcctcgccgccgggagcttcctcgaggacctccacaaccgcgtctccctcctctgcttcgactccgtccaccccaccgccgcctccttccgcgccgtcccctccctctccttcgaccacccctacccgcccaccaagctccagttcaacccgcgcgctgcctccacgcccctcctcgcctcctcctccgacgccctccgcctctggcacgcccccctcgacgacctctccgcctccgcccccgcccccgagctccgctccgtcctcgacaaccgcaaggcctccgcctccgacttctgcgcgcccctcacctccttcgactggaacgagatcgagccccgccgcatcgggaccgcctccatcgacaccacctgcaccgtctgggacatcgagcgcggcgtcgtcgagacgcagctcatcgcgcacgacaaggccgtgcacgacatcgcctggggggaggccggcgtcttcgcctccgtctccgccgatggctccgtccgcgtctttgatctccgggacaaggagcactccaccatcgtctacgagagcccccgcccggacacgccgctcctcaggcttgcctggaaccgctatgacctacggtacatggccgccctgctcatggacagcaacgccgtcgttgtgctcgacatacgcgcacccggggtgcctgtggccgagctacatcggcatgggggatgcgtcaacgctgttgcgtgggcaccgcaggctgcaagacacctctgctccgcaggggacgacgggcaggcgctcatctgggagctgcctgaggcaccggcagcagtgcctcccgaagggattgatccagttcttgtttatgatgcgggtgccgagataaaccagctgcagtgggtggccggacacccggactggatgggcatttccattgagaacaaggtccagcttctccgggtctgacaagaacatctctgaagaacgctcaattcaagggaacatttctgaagaacgctcaattcaagggaacatttctgaagaacgctgattcaaactatctgacatatttggtacgccattgacatcgaagaagtcatgctgctttctcttctgtgacacatttcgctaccatggaatgatttgttgtcggcatcatcagccccactgtctgagcctagtagattgatctcactgcgaacatggacatatagtctatagcatctgctagtgttagtaaagggagttggaggttggctctggtcaagtggtcactcgttgcgctgggcttcctagtatttccagttttctattttactctttctttcgggtggacacagtttcctttggtcgtctgttcatactcgggctgtatattgtgatatttattttcgagctgaatttgcacatatcacaaaaaaaaaaaaaaaa

SEQ ID NO: 2532 - DNA, 471 bp, Triticum aestivum
  misc_feature: Ceres CLONE ID no. 785819
  misc_feature: Encodes the peptide sequence at SEQ ID NO. 207
  misc_feature (465)..(465): n is a, c, t, g, unknown, or other
tcgctctcggggttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcctggccgccgccgccgtcttctactgagaranccgcag

SEQ ID NO: 2533 - DNA, 614 bp, Triticum aestivum
  misc_feature: Ceres CLONE ID no. 788576
  misc_feature: Encodes the peptide sequence at SEQ ID NO. 856
tttttagcaaaagacatttgaagcgccgtcgtttcatccttcttagtctccttgaaaagaaaaaccctaattacaaggcacaaaggaagtggaatcagagctgagaaaccctaacaatgggaggcaaatgtccgcataggaacgtgaagaagagaagatattctcacaagacagcgcggcgtacgaagtttgagttgaaaggggacgacatggtttatgcgcagctgaacaaacccgatgaagagagagcccctttacccctcgatgaagatttgcctgggatgggccagtactattgccttcactgcgatcggtacttttccaatgtagccgtgagggatgagcactttaagaccaaacgacacaagaagcgtataaaacaaatgatgggtcctgcaccacatactcaacttgatgccgatgtagctgctgggatgggtatgccagacaatggaccaaagctaatgtctatgtaacttcttttttggtagtgggtgagacgatagtcttaggagctggtgttataaagatatagtgtttgttatttttcttctttttatgttactagtactggttattctattccaatataagcaatattatattttgaaagc

SEQ ID NO: 2534 - DNA, 473 bp, Triticum aestivum
  misc_feature: Ceres CLONE ID no. 815584
  misc_feature: Encodes the peptide sequence at SEQ ID NO. 201
ctcatcgctctcggggttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggcggcggcggtggctacggcggcggcggtggcggctacggcggccagcgcggc

SEQ ID NO: 2535 - DNA, 1614 bp, Triticum aestivum
  misc_feature: Ceres CLONE ID no. 824827
  misc_feature: Encodes the peptide sequence at SEQ ID NO. 2018
ccttgactcttctcttcgtccttgaccgagggcgactctctgtctctctctctctccgcctccgccgagggcttccgagaatccaccagcggagcagcgagacagggacccctccgccgtcaccaacaccgccctactcgccgccgcctcaccgcctccaccgccatcttctacgtcctcccgtccccgtaccggagatccggcggttctcgtgaccggaagatatttggctttgcacgaacaagatctcacatggagccatcctcgcagcctgagcctgtcgtgggtgtggccactgctgggtcacaagcatatcctcctcctgctgcctatccagctccagccatgcctgccgccattcctcctggctcgcagccagcagtgccattcccagctaatccagctcaactcagtgctcaacaccaactggtttaccaacaagcccagcaatttcaccaacaactgcagcaacagcagcagcagcaacttcgtgagttctgggctactcaaatggaagagattgagcaggcaactgacttcaagaaccacaccttaccactggcaaggataaaaaagataatgaaggctgacgaggatgtccggatgatctccgcagaagctcctgttgtctttgcaaaggcatgcgaggtgtttatcttagagttgacacttaggtcatggatgcacactgaggagaacaagcgccggaccttgcagaagaatgacattgcggctgccattaccaggactgacatctacgacttcttggtggacatcattcccagggatgacatgaaggaggaaggccttgggcttccgagggtgggcttgccacctgctgctctaggggcaccggctgatgcctatcctccttattactatgtgccagcacagcaggtacccggagtaggaatgatgtatggtggtcagcagggtcacccagtggcatatgcgtggcagcagcctcaagggcaacaggccgaggaggctcctgaagagcagcagcagtctccctcaaactagccaagagattgatgcaatgaagccatgacatgatcctgaacttgatgcctataaactcaggcttgtgttaatttatttccgtcatcgttggccggaacagttactcatggttaggtcttagggggggttcctaatggtagcttcgacgctggtatgctaccagcggtaggaaaaaaaagattgtgatttgttaggtgatttgaaactgatttagtaaacagtaccttcgttttcgccctagtttctatctaatcaaatattccaaatgcccgccttgtggagagccttgtaagaatcgatcggtgcaggctgatgtcactcctgtttgtttgcctcatttaccagtcatgatgctgcctgcctcgcaagaatcctgccttccgatttggcagtcaccacaccagggcatgaagaccgcctacactttggagcatgaaaaacaggttggttccttgtgtggaagatagaactgtctgtctctgctccctgtttgaggaataacgggggacatgaattattgtgctttccagtgtagctgttgaatctgtgtgcttaatttggagtatatgcatttcaaaaaaaaaaaaaaaa

SEQ ID NO: 2536 - DNA, 1694 bp, Triticum aestivum
  misc_feature: Ceres CLONE ID no. 833872
  misc_feature: Encodes the peptide sequence at SEQ ID NO. 1439
cccctctctccctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctcccccgccccccgccacggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagtgcaggaaatcagggaatgcaatcaccctacagatccagttcgtttcctgcacctcagtatgcactgcagagagagaatgtatttcctgagagacctgatcagccagaatgcatatactacataaagactggagattgtaaatttggtgcggtttgcaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatgggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaagccatttgctaccgaatgaaataatgcttgaatgcagtgttgaaaaaaaaaaaaaaaa

SEQ ID NO: 2537 - DNA, 1654 bp, Triticum aestivum
  misc_feature: Ceres CLONE ID no. 835085
  misc_feature: Encodes the peptide sequence at SEQ ID NO. 1118
agtgttctcaagcccaaagcgtccgatcaatcacagaaaatcgtccctccatatctccccagctcttcttcctcctccgacctcctcctcagctcccgtgtcatctggttcttcttcctcagatagcgaagaaggctagtagatccggtcgagagggcgcggcgatgtcggacgtgacggcggtgatggatctggaggtggaggagccgcggctctcgctcccgccgggcttccggtttcatccgaccgacgaggaggtggtcacccactacctcacccccaaggccgtcaacaacgccttctcctgcctcgtgatcgccgacgtcgacctcaacaagaccgagccgtgggatctccccgggaaggcgaagatgggggagaaggagtggtacttcttcgtgcacaaggatcgcaagtacccgacgggcacgcgcaccaaccgcgccacggagaaggggtactggaaggcgacggggaaggacaaggaggtcttccgcggcaagggccgcgacgccgtcctcgtcggcatgaagaagacgctcgtcttctacaccggccgagcgccccgcggggacaagacgccgtacgtgatgcacgagtaccgcctcgagggccagctcccccaccgcctcccccgctccgccaggaacgattgggctgtttgccgggtgttcgacaaggacttggcggcgaagaatgcgccgccccagacggcgtcggcggccgtcggggtcatggaggacccgtacgccttcctcgacgttgacgacttcttcaacaaccccgacctgccgatgctcatggactccccgtcaggcgccgacgacttcgccggcgcctcgagctccacctccagcgccgccgtgccgctggagccggacatggagcacctttccatcaagacggaaccgccggtgccgcagcagcagatgcagagccccaactacttcttcatgccggcgacgacggccaacggcaaccacggcggcggcgcgtactcgccctaccaggccatgggggagcagcagagcgcgatccgcaggcactgcaagccggaggcggcgtcttcgtcggcgctgctgagcccctcgctcggcttcgacaccggggcgctcgccggcggggacacctcgttcgtgataccgtcgtctcggtcgtacctcgatctggaggagctgtgccggggcgagcctcccatggactactccaacatgtggaagatctgattgaatccatccatctctccgatggaccggagcgtctcagcttgctggtagccatagacggttaatttggttggtgctagctcttggattgattagttgcttcattaactttggttattaaggattgggttaattaggcgcgcggcgatgattcgaggaggatcgtcgcgtgtgttgttgttgatgcgtgcaaggcatgtgagcgagcgagtgctgattaatcttaattagggtgtgagatatcaaactgctaggaggcatctgtagtttgtttgtacatatataggtaccagattggtgtcatacagttcagtgattaggggggtgaattggagggtgagagatcataccgagaccgagtttgattgatgaatctgattgtgtgttgatggaaatgaattattccccttccaaaaaaaaaaaaaaaa

SEQ ID NO: 2538 - DNA, 1510 bp, Triticum aestivum
  misc_feature: Ceres CLONE ID no. 843382
  misc_feature: Encodes the peptide sequence at SEQ ID NO. 115
atttacggacacaccatctctctctcccccccgcaaccgtccaagacttgcaacagctcgccgcccgcaacaacgtcacacagacgccgcatcgtggaagggaggcggcatgaagacgaggcgtggcgcgtgctactcctgccatgagtccgccgcggccgaggcgccggagatgcaccgtcggaagaggcggaggacggccatggaggcggcggggtgtgctgccgtcggagacatgttcgaggacctgccggatgatctgttggtgtccatacttgctgatgtggccgcgtccgcccgctcgccggccgacctcgccggcgccatcatgacgtgcaagagattcagggagttgggccagagcaaggttgttcttgccaaggtgtcaccgcggtgcctcgccgtccgggccaaaagctggtcggactccgcccaccgcttcctgcagggctgcgcggacgccgggaacctcgacgcatgctaccttcttggcatgatccggttctactgcctggggagccgggggtcgggagcggcgctgatggcggcagcggcggtgggtggccaccgggaggcgctctactcgctggccgttatccagttcaacggcagcggtggcagcaaggacgaccgcgacctccgcgcgggcgctgcgctgtgcgcgcgcgcggcgtcgctcggccacgtcgacgcgctccgcgagctcggccactgccttcaggacggctacggcgtgcgccgctccttgctcgacgggcgccgcctcctcatccaggcgaacgcgcgggagctcgccgccgcggtcaccacgtcggcctctttgctccgcgcggcagccggcagcggcaaggcctcgaggaggcactcgtgcctgctcagcgacttcggctgccgcgccgcggccgccgcggccggcgaggcgcatgccgccaaccggttcctcgtcgagtggttcgcgttgcggccgctgggcgccgagagcagcccagcgccggcgccggcgccagctgaggagggcggtggcctgcggctgtgctcgcacgcgctgtgcggtcggccggagacacggcggcacgagttccggcggtgctccgtatgcggcgtggtgaactactgctcgcgcgcatgccaggcgctgcactggaagatggcgcacaaggccgagtgcacgcccatggaccggtggctcgacggcgccaacgcgaaccccaaccccaatgccgtcgcaggcgcaggcgacgccgcggtggccgctccggccctgtaaccgccgccgtgtccttgcacccgtttcttttatttttctggccagttctttcctctttttcttccttggtctttttccggacccttctctgtacatggtcgctgcggtaaaggttagccgagtctggttacttgcgaattgcttttagtaagaaaaacttttattaacctcgagtaagtactgttttgttctgaaagcaaaacaatacactacaatgtttttaccacaaaaaaaaaaaaaaaa

SEQ ID NO: 2539 - DNA, 1202 bp, Triticum aestivum
  misc_feature: Ceres CLONE ID no. 844350
  misc_feature: Encodes the peptide sequence at SEQ ID NO. 1685
cccgaagcttctcgatccctccccccgcttccgtttccgtttcgtccccgccgtcgccccctcgccgcggcggcggagtcgcccgcactcgctgcgcgcaggaacgatgagccgacgtagtaacggccgcaccatctacgtgggcaacctccccgaggacatccgcgagagagagattgaggatctcttctacaagtatggtcctattgtcgatatcgatctgaaaattcctccaaggcctcctgtttatgcttttgtcgagttcgaagacccacgtgatgctgatgatgcaatttatggccgtgatggatatgactttgatggccacaaattgcgggtggagttagctcatggggggaaaggcccttattttattcgaccaagcagctatagtagttctggacgtcatggtgcagttaggcgttctgattaccgcgttattgttaccggattaccttcttcagcatcatggcaagatctcaaggatcatatgcggcgagctggtgatgtctgtttctctgatgtttatcctgaggctggagcaattactggaatagttgagtataccaactacgaagacatgaaacatgcgataagaaagcttgatgattcagagttccgtaatgcattttcacgagcatatatcagggtgagggagtacaatgctaggcgtagccgctcttactcgagaggtagaagccgaagctgctcttactcaagaagcagaagtcacagttatagcaggagcaagagtccaaggtctagacctgcttctcggtctccttcacctgttaaagcaaggtcatcatcaagatccctatcacctgccgctcctgcccatgacaagtctgcaagcaggagccccgtcaggagcagaagtttaccccgttctcagtctcctgtgaaatctgagtgaagccagatgcactcgaagtcagggaaaaaaaacatatcaggatttgttggattaggacaatataatatggattgtgggtgctctgtcccaagaagtaccattgctgttccttggaaggaaaaacgtcaactttgtggtttgagatcaatgtaggagtctggtgttgttttacttctgcactcagttgcgagaacgtaaaagcgtgaactcatggctttaactttagtatgctatagtttcgcgtcaaaaaacttcatgccacagcagagtaaaaaaaaaaaaaaaa

SEQ ID NO: 2540 - DNA, 482 bp, Triticum aestivum
  misc_feature: Ceres CLONE ID no. 867872
  misc_feature: Encodes the peptide sequence at SEQ ID NO. 212
ctcatcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggsgcggcggcggcggctacggcggctacggcggcggcggtggtggctacggcggccagcgtggtggcggtgactccggcggccagtgg

SEQ ID NO: 2541 - DNA, 1252 bp, Triticum aestivum
  misc_feature: Ceres CLONE ID no. 869920
  misc_feature: Encodes the peptide sequence at SEQ ID NO. 636
ttccccatcgtctctacctgcttatgcattagagcccccggagttgccttcgattcgcagctaagtcctgctttctcccttccccttcttatttcagtccctgtagtttggttttccttaagagtctactccctgttccgttgcaaataagcccctgagctctgtcctattctagcctcaactccttggtctcgggaggagttcgtcgcagattcgatctagagagcctccccgcaccacccatgtttaccctccccttcctctgacggccgccgtcccccgatgaagctgcgcgtccgctgccgctcccactccttctccgtcgccttcctctactggttctacgacttctcatgaactcctcgccccccgacaacgccgcatccatccagcctctagttgattagatccagcctcgtttcttccactttcttgccttcttcctccccaccatcaaagaaaagagatctcttttctggttcttggatcaagaacccgaccgaccatgtcgtcgccgtcgcgccggagctccagccccgagagcaacatcgacggcggcagcggcagcggctccgccggtgacgagcgcaagcgcaagaggatgctgtccaacagggagtcggcgaggcggtcccgcgctcgcaagcagcagcggatggaggagctcatcgccgaggccagccgcctccaggccgagaacaagcgcgtggaggcccagatcggcgcctacacgaccgagctgaccaaggtggacggcgagaacgccgtgctccgcgcgcgccacggcgagctcgccggccggctgcaggcgctcggcggcgtcctggagatcttccaggtggccggcgcgcccgtggacatcccggagatccctgacccgctgctccgcccatggcagtccccgttcgcgccccagctggccaccgccggcggcatgcctgacgcgttccagttctgagccaagacaagtcatgccacggcgacattgcgccaccgtggataaggttgatgattactgctgctgctgctgaagaatgctagtactactagtttgtttgcttcatgtttaattatggtaatcctagaccatcattagtacttattttgtgattgtaatcttcctattgtcctagccagtggatatggataagaacaatgtcattgatgtgtggcggagcacaaatggattgtgcctatctttgggttgatttgtaataacatcttgacatggaacctaaaaaaaaaaaaaaaa

SEQ ID NO: 2542 - DNA, 713 bp, Brassica napus
  misc_feature: Ceres CLONE ID no. 873113
  misc_feature: Encodes the peptide sequence at SEQ ID NO. 1449
aaaaatctgaatcgtcgtcggtctctcgctctctcgtcaaaacaaaaaccctaacgttcacagatctctcgaagatgaaaggtggtgaaaccaaagctcaatcgaagagcaccgatgaaagattgaaaacgagaggaaagaaagctggaaagaaagcagccaaggaccctaacaagcctaagaggcctccaagtgccttcttcgtcttcctggaggggttccgtaaggagttcaatctagctaaccctgacaacaaatctgtcggagctgttggtaaagccgctggagctaaatggaaatcaatgactgatgaagacaaagctccttatgtagccaaggcagagaccaagaagactgaatataccaagactatgcaaaagtacaacatgaaactggctaatggaactagcacagctggagatgatgactccgacaagtccaagtccgaagtcaacgatgaggcagaaggtgcaagtgaagaggaggaagatgatgattaggagatggatcagccagcgatttgtctttatggagkatcttctgttgkactgttattagctgctagtttttagtgactattgctatgctttcccctcctttatgttaactgggatgtattygtaatyttyttcaacttytcatgacaactttgaatttagctttgatcttttgtctctacttttttaaacgatggtattatttgtttgcatgcc

SEQ ID NO: 2543 - DNA, 468 bp, Brassica napus
  misc_feature: Ceres CLONE ID no. 873740
  misc_feature: Encodes the peptide sequence at SEQ ID NO. 187
  misc_feature: Encodes the peptide sequence at SEQ ID NO. 224
atcacaccttccctctcttcactgtaaacctactacatctccccctctctctcatttcaatggcgtcccctgatgttgagtaccggtgcttcgttggaggtctagcttgggccaccgatgacagagctctcgagaccgccttctctcaattcggcgacgttctcgattccaagatcattaacgaccgtgagacgggacgatcaaggggattcggattcgtcaccttcaaggatgagaagtcgatgaaggacgccatcgaggggatgaacgggcaggatctcgacggtcgcagcatcactgtgaacgaggctcagtctcgtggtagcggtggtggcggaggaggccgcggcggaggcggtggtggataccgcagcggaggcggtggtggttacggaggaggtggtggagggtacggtggaggtggtggaagacgcsagggtggatacagtggtggcggtggtggtggtt

SEQ ID NO: 2544 - DNA, 415 bp, Triticum aestivum
  misc_feature: Ceres CLONE ID no. 890211
  misc_feature: Encodes the peptide sequence at SEQ ID NO. 549
aagcctcttgagacacacctactacagttgctaaagtccttacttgcaacaatgaagcttgtctttggcaccctactattatgttctcttcttctaagcttctctttcttggagccagtcatagcctatgaagactcatcttattgcagcaacaagtgtgcggacagatgctcatcggcaggggttaaggataggtgtgtgaagtactgtggaatatgctgtgttgagtgcaaatgtgttccttctgggacctatgggaacaagcacgagtgtccttgctacagggacaagctcaacaagaagggcaagcccaaatgcccttgaacttcaactcaaacaccaagtcgaatagagacttaagagtagtagtttttgcatgtggttgtattcttgttttcatgtctgttgggtatgt

SEQ ID NO: 2545 - DNA, 1152 bp, Triticum aestivum
  misc_feature: Ceres CLONE ID no. 892214
  misc_feature: Encodes the peptide sequence at SEQ ID NO. 1101
atttgtttccagccggagttttactaaacttggacggagcggttccgttcccttcccgagctttccagatagccggagagccttctggacctcgatctaccatcatagctttgcccatctggcaaggacccaacagccgtgagaaaaaggaaagaatccatcagagcaacagttttgctccaaggaataaagccaccaccccgcccccctctgcccaaaaaggcgaataaaaccaaaagccaacctagtctgcaacttcgcgatcatcaggggctattttgctgtagaccatccaatccaaccaccttaaataccgctgattggggcacaatccttaacccagaaatagcactgctgcacattggttagtgcctcctctcccaacacctcctctttgctcacagcttccttcaacaccttcgtccagaaactctcgcagacatggcggccgggaagcgcaccatcggcctcgcgatggactactcgccgtccagcaaggcggcgacgaggtgggtggtcgagaacctggtgaaggccggcgaccgcatcatcctcatccacgtcctacccaagggagcagacgccagccacaagggcctctggaagagcaccggttcacctctgatccctctgctggagttcatggagatgaacgtgcaggcgcggtacggggtcaacccggacaaggaggtgctggagatcctgcaggctgagtccaagtccaagcaggtggaaatactggcaaaaatatactggggtgatgcaagggagaaactttgtgaggcagtagatgatctcaaggtcgactcagttgtgcttggttgcaggggattagggcccttaaaaagggcactccttggaagcgtcagcaactatgttgtcaacaatgcaacctgccccgtcacagtggtgcgcggaccaaatggatcacttgcttgaagatgtcacttctggaatgatgggctagcttgcgtgttcattggtccgtcagcataggtgcaaatggtgctatttaagaggatagtgatatttgcctctttggatttcctggctatccttgtagtgcaaattcagtgtgttttcatctgttatattctagttatactacatttctgttgtttcttacatactatttgtaagaaaaaaaaaaaa

SEQ ID NO: 2546 - DNA, 1634 bp, Zea mays
  misc_feature: Ceres CLONE ID no. 894637
  misc_feature: Encodes the peptide sequence at SEQ ID NO. 1923
tattcgccaacaaactcatttcccgtctccacttgttcctcctctgtgctctcgcctttccattcctccaccggcctcatcccccaactccgtcgagcattaccgtcagagggcggcggcgcggcgcggcgccgccggcgacggggaccgcgtgaggcaggctcccctcaaggctcgtcctcctcgtcgggaggcgtcgccgttgccccgccctctgggctggcgcggcgtggaggggacagctggagatccgcccgtctctgcttggattgcttccttctcccgcagagggtatgagcaatgtactcaccaaaaccagagtctagttttggcccaaatcccaactcaggtacacaccagcagcaaatggaattaactggggccaacatgggtcctggtaatggagcaaataacaataccaacatggctgggaggcaacgcttacgctggacaaatgaactgcatgaaagatttgttgaggctgttactcaacttgggggtcctgatagggcaactccaaaaggagttctgagaattatgggtgtacaaggattaacaatataccatgtaaaaagtcacttgcagaaatacagactagcaaagtatattcctgatgcttcaactgatgggaacaagaccgataacaaagacccaggagatttgcttgccggacttgagggatcctctggattgcagatatctgaagccctcaaactgcagatggaggtccaaaagcggctgcacgaacagttagaagtacaaaggcagctgcagttacgaattgaggctcagggaaagtacctccagaagatcatcgaagagcagcagcgcttaacaggtgtgaaatctgaaactcctgctggaggtgcttctgtcactgtatcaagtgatcaattcccagactcggagcggactgagccctccacacctgcaccagcatccgagtctccaactcaagttggtgcttccaatagggacactggagaccgaactgaagcaaccaagagcacctgtcatggtgattctctttcccgcaacgagccactaacccctgattccaactgccagaacggttctcctgtcgctagtccaaaccatgaaagggcagccaagaggcagcgaggcagtggtactgaattcttagattctgaggctgagttttcccttccgcgccacatcttcgagtcgagttcaggctcagagttccaacaatactcaatgtcctactcaggacagtagcttctgatgttcacatcatctctgcaccgttgctagcttgttcagcacgatgcgcatggtccgtaggtctgggtaggttgatgtctcaaggagcgtgttgttggtaaacaaagctgtaggtgttcagtgattgtctacatggtatacgtgaccagctatttaagttcctaggtttgtaacatgtatgtccgcctgcagttcagttgagatgcttcaaggctaaggttctgttgtgtgacctgtagacacgaggctgtcagcttgtattctcttggtaatgtgtgtcagcagagcgttagcattaagtctaattgaacagtgctgttatctgtaacgtctgagtttgatcagaaactgaagttaattgaggaagacatctaaaaaaaaaaaaaaaa

SEQ ID NO: 2547 - DNA, 471 bp, Triticum aestivum
  misc_feature: Ceres CLONE ID no. 900490
  misc_feature: Encodes the peptide sequence at SEQ ID NO. 1114
  misc_feature (417)..(417): n is a, c, t, g, unknown, or other
cagtgttctgaagcccaaagcgttcgatcaatcagagaaaatcatccctccatatctctctagctcttcttcctcctcctcagctcccgagttcttcctgagcgaagcaagccaagctaggtagcagatccgagaaggcgaagcgatgtcggacgtgacggcggtgatggatctggaggtggaggagccgcggctgtcgctgccgccgggcttccggttccaccccaccgacgaggaggtggtcacgcactacctcacccccaaggccgtcaacaacgccttctcctgcctcgtgatcgccgacgtcgacctcaacaagacggagccgtgggatctccccgggaaggcgaagatgggggagaaggagtggtacttcttcgtgcacaaggatcgcaagtacccgacggggacgcgcancaaccgcgccacggagaaggggtactggaaggcgacggggaaggacaaggagat

SEQ ID NO: 2548 - DNA, 982 bp, Triticum aestivum
  misc_feature: Ceres CLONE ID no. 902699
  misc_feature: Encodes the peptide sequence at SEQ ID NO. 1529
  misc_feature: Encodes the peptide sequence at SEQ ID NO. 806
ataaaagacaaacagctctatttttatgtgcccttcatactcatattctctgtgcctctctaaatcaaagctcaccctccctctccaccttgggaagatcataccaacatggaaagtgatgctggggaaaacttgtttggcacattctcctcctccacgacatccatcaccgcctcatcatcgtcatcaccaacatcttccaccacaacaagctcaaactcatgcaccaaacatgactccaaaataagtccacctcaaaatcaaaacaccccaaatagcaagaaaagacaaagaagtgatgacaatgagaacaaacaccaccctagttatagaggtgtgagaatgagagcatggggaaaatgggtgtctgagatccgtgagccaagaaagaagtcaaggatatggcttggaacataccctactgcagaaatggcagcaagagcacatgatgtggcagctttagccgtcaagggccattcagctttcctcaatttccccaatttagctcaagatcttccaaggcccaccaccacatctcccaaggacattcaagctgcagctgcaaaagcagcaaccaccactttctttgatgatgaaattgttaaccactgtcaagctgaaaaagctgaacaaaaccatggagaacaacaagcttctccttcaactctatgcatgatggacaatagtactgaagcagagcaaattcaagcagaacaagcttcttccactcaagagtcttctagttctcattctactgcagatgaagagacactgtttgacctaccagatcttttccctgatggaaactctggacttttctcctattcttcttgttggcatttatgtgcagttgatagtggattcaggctagaagagcagtttttgtgggagaatttctagtagtagagattgtttcatttttaaaataaaaaatatatataataagagaaaacagactataaaattgatgaggttttatctt

SEQ ID NO: 2549 - DNA, 2385 bp, Triticum aestivum
  misc_feature: Ceres CLONE ID no. 918824
  misc_feature: Encodes the peptide sequence at SEQ ID NO. 1731
cctcgtcctcatccaaaccccgaccgaatccccaacatcccccaccgccgcagataaaaatccaaataatcgaagccccgccgtactctcgcccatggcgctgctgcagctgcatccgccgccgctggcggcgctcggtcgctccgttctcccctgccgcccgttcccctcggcgaccgcgaccgcccgccgctccctcgcctcggtcgccttctcgctccagaccaacgtgcgcctcctcaagcccaaccgccgctcccggcgctcccgctacccctactacgacctcgacgacgatgaagaggaagaagatgaggagtacgacgaggacgacgagagcgaggacgatttatcaggtttggagtatcttggtgtcctttatacaaacaacccgcgtgctccgaacaagagagcaggacgaaaaacacaactggtgaaagaaaattgggaaggaaggcggcccaaaactcgtgataaacatgctagtccaggaaggtctaattccctccagcccaggagcaaaataaacagaacattactaaatcttacaagcatgaacagtgaagtagagttgaaaaatgaaagcatctctcgtattctgtttgaaaaattgcaagaagaatatgactttgatgataaatggttaccgcttattgattacctgtgctcatttggactgagggaatcccattttacttacatttatgaaagacacatggcttgcttgcaaatcaaccgggcttctgcagaagaaaggttggagttccttctaagtgttggtgttaaaagcaaggatctgaagaggatgctggtcagacagccgcaaatcttggaatacactctcagcaatctgaagtctcatgttgcttttctggctggcattggtgttccggatgcacgtatggggcaaattatttcttctgccccttcatttttatcttacagtattgagcagtccctgaagccaactataagctatttgattgaggaagtgggtattgaggagagggatgtgggaaaagtggtgcagctaagccctcagattctggtgcagcgaattgataatgcgtggaaatctcgatttctttttctctcaaaagaactaggggctcccaaagatagcattgtcaaaatggtcacaaagcacccacagctgcttcattacagcattgaggagggcatcttgcctcgaatcaatttccttagaagcatcggcatgagaaactctgatattctcaaaatattgacaagtcttactcaggtgctatctttgtcggtggagaaaaatctcaaaccaaagtatctttatttggtcaatgaccttaagaatgaggctcaatccctgacgaagtaccccatgtacttgagcttgtctcttgagcagagaattcgtccccgtcaccgttttcttgtttcattgaagaaagctccaaaaggcccatttcctcttagctcctttgtgcttacagatgagcgtttttgccagcggttggctgggacgagcttagagaagtaccatacatttagacagagcttgctgctgacaggtttcgaagataagactggaaggaaaccattggcatcacgacggtagatagtttgaggaacttgaccataggcaagagggttgcttctgacttccgtgcctgtcctcactgtaagaaagctccagagggtctatttcatattaacctccctcgcgcctgtggacgagcatttttgccatcaatgagcctttgactaacttagagagagaagtaacatacatcgagacagagcgtctgttggcaggttttgccgagaagtctgaaggaaattgttagcaccaaggcagtagatgattaatattcagctgataggttgcgttttagactatgagcctgtccttcctcactgaaatggcctaggttgctggcctggttacccctctgttcagctgttgccttgtgaaacatcttgtagagtctttctgatagctccggatcaactacaaatggatggttcatctgacagaacagcatccaccggaatagctgatcgaacattctgctaactgcttaaagagtagctgccttgacttctacttacggttaaccgcaactttcgagcaacatattaagtctagcaaaactgcagcttgaccatatagcgtgcaacttctgtgtcagacatatacgtcctccgttcccaaatatttgtctttctaggcatttcaaatggacacaacatacggatgcatgtagacatattttagagtgtagattcactcattttgttccgtatgtagtcacttgttgaaatctctagaaaaacaaatatttgggaacggagggagtagtaggctatagtaaattttcttcagggttgtgaaaaaaaaaaaaaaaa

SEQ ID NO: 2550 - DNA, 447 bp, Triticum aestivum
  misc_feature: Ceres CLONE ID no. 924811
  misc_feature: Encodes the peptide sequence at SEQ ID NO. 203
ctcatcgctctcggggttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggcaagcatggctgccgtcctcacccgc

SEQ ID NO: 2551 - DNA, 666 bp, Brassica napus
  misc_feature: Ceres CLONE ID no. 944101
  misc_feature: Encodes the peptide sequence at SEQ ID NO. 1647
  misc_feature: Encodes the peptide sequence at SEQ ID NO. 1762
aaaagtctcacataaaaaccttgagtgtaatctatctggcaattaaagactcacaagtgaagaaaaatgcaacaagatctcacatcttatgactgctcctcggtactggattcgattcgccgacatctgctggaggatgactcagagagtctctcttctttctccagcagcagctcaccagatctggaatctaccagaagaagaggaggcaacttcaaaggagtgaggagaaggccttgggggaaatacgccgcagagatcagagaccccaacaaacatggagccaggatatggctcggcacttacgagacggccgaggaagcagctgcggcctacgaccgagccgctttcaagttgcgaggggccaaggctaaactcaacttccctcacctcatcggcattgatggccctgaaccgtcaaggatcaccaagcgccgcctgagtacaccagtctcatgttcacctgtggctagaagacgcaacactgacattataaacctgacggctagagttccatgccttgcttttcattatttcwacaacattgactytaccacttggtgttgattaccggtcacaacatcggattcgatgaaatgcataaacttttatgaatcaatcaactgtaccaacttttgcttgtctattcatatcatttttaagtcg

SEQ ID NO: 2552 - DNA, 489 bp, Brassica napus
  misc_feature: Ceres CLONE ID no. 945779
  misc_feature: Encodes the peptide sequence at SEQ ID NO. 230
acacatccttctcttcactgtaaaccttttatatcaatggccgcccctgatgttgagtaccggtgcttcgttggaggtctagcatgggccaccgatgagaggtctctcgagaccgccttctctaagttcggcgaacttgttgattccaagatcattaacgatcgtgagaccggaagatcaagggggtttgggttcgtcactttcaaggatgagcaatccatgaaggatgccatcgaagggatgaacgggcaggatctcgatggtcgcagcatcactgtgaacgaagctcagtcccgtggaagcggcggaggtggccgtgggggtggcggtggataccgcggtggtggtggtggtggctatggaggcggcggtggtggttacggaggcggaagacgggagggtggatacagtggcggtggaggtggctactcatcgagaggaggtggtgggggaggatacggtggaggtggcagacgtgagggtgggggt

SEQ ID NO: 2553 - DNA, 727 bp, Brassica napus
  misc_feature: Ceres CLONE ID no. 945972
  misc_feature: Encodes the peptide sequence at SEQ ID NO. 1362
aagacaatcttctctttctccactctcattctctttctcactctgacgcatcaactacttatttttcctgcattgctttctctctatctctatctctcacacacgcatacacacaaagacatttaacatatatcaagaaagaagatgtcgagcagaagatcatcatgttcaagacagtccgggagctcaagaatctctgacgatcaaatttccgatctagttaccaagcttcaacacctcatccctgaactccgccgccgccgttctgacaaggtgtcagcatctaaggtactacaagagacttgcaactacatcaggaacttacacagagaggttgatgatctcagtgaccgattgtccgaatttttggcttccacggacgacaacagcgccgaagcagccatcattaggagcttgcttgattattaaaatgatcgttagttaatctgagaactacgaatgttcgttttccatcagggaggtttatcttcttatcattatgagtctttgtttccttctacttcaaatattatgatatagctagggtttcgggtcattgttaggccaactcatatattatgtataatatgtggtttatgaatttatgtatgtatgagtatgtatgcatcttaattgtttgtgagggtccagmctcaggatgtatagtagcctgtgtatcgtgagatcctctaatatttatgattaatgggatagtccgtttcctctt

SEQ ID NO: 2554 - DNA, 514 bp, Brassica napus
  misc_feature: Ceres CLONE ID no. 951040
  misc_feature: Encodes the peptide sequence at SEQ ID NO. 1811
atacactttgtgtattcaaagacccaaaatactccctcttatattcgtccccctctctttttttcttcttaatcttttcttttcaactttaaaccttatcaaatcataaaggctatatacctacttgccacatagctcatttctcaatttcttaaactattctacaatccagtcagagtatataaacaaacaacttaagagttgttttgctacattgttgaatatgtcaaacagaagatcaaggcagtcttcaagtgctcccaggatctccgatgatcaaatcatcgaccttgtaactaagctccgtcagattttaccggagattggccaacgtcgtcgttccgataaggtctcagcctccaaagttttgcaagagacatgcaactacatacgaaacttgaacagagaagttgacaacctcagcgagcgtttggctcagcttctcgaatccgtcgatgaagatagccctcaagcggccgtcattagaagtctactcatgtaatctgttattatt

SEQ ID NO: 2555 - DNA, 976 bp, Brassica napus
  misc_feature: Ceres CLONE ID no. 953644
  misc_feature: Encodes the peptide sequence at SEQ ID NO. 2013
gatccaatcacaaagcgtagagatccaatggacaacaacaaccagcaaccaccaccaccacctacctccgtctaccctcccgcctccgccgcgaccgcaatccctcctcctcctccttccggatctacaccgataatccccggaggaggaggagcctcgtaccaccacctcctccagcaacagcttcaacagctacaaatgttctggagctaccagcgcaaggagatcgaacaggtgaacgatttcaagaaccaccagctccctctcgctcgcatcaaaaagatcatgaaagccgacgaggacgtccgcatgatctccgccgaagcgccgatcctcttcgccaaggcctgcgagcttttcatcctcgagctcaccatcagatcttggctccacgccgaggagaacaagcgccgtacgcttcagaagaacgacatcgccgccgcgattaccagaaccgatatcttcgatttcctcgttgacatcgtcccgagggaagagatcaaggaggaggaagaggcggctttagggagtatggtggcggctccggccgtgagcggcgttccttattactacccgcctatgggccagccggctgttcctggaggtatgatgatcggaaggcccgcgatggatcctagtggtgtttatgctcagcctccttytcaggcctggcagagcgtgtggcagaattcagctgccggtgatgacgtgtcttacggaagcggagggagtagcggcggccatgggaatctcgataaccaaggttgagaagcttggaagaatttttcagatgctgccttgtytgaaaaccagaagctgagcttaatcatcaaccctgcttttatttttgcatgtgtctgattyttaattatgtatgtttgtgatttaatggcttacttgtaagaagagagacaacaacaacaacaagaacactcttttcattytcttcccctgttaacttataagttattgcagc

SEQ ID NO: 2556 - DNA, 570 bp, Brassica napus
  misc_feature: Ceres CLONE ID no. 955105
  misc_feature: Encodes the peptide sequence at SEQ ID NO. 174
aagagtcttgtgtaaaaagaatctgtgatttgtctgatttttggttttgcgagtgtactttggtctgaaagaaaaaaaaaaatgtcgtggagaggaaaacgaaaagacgaggatgtccgagcatcagatgacgattctgaaacccacgctccggctaagaaagtcgcaaagccagccgaatcctccgaggagtctgacgacatcgtcgtctgcaatatatcgaagaacaggagagtctctgtgaggaattggaacgggaagatttggattgacatacgtgagttctatgtcaaggacggtaaaactttgcctggcaagaaaggtatctctctaagtgtggatcagtggaacactcttcggaaccacgcagatggtattgataaggcgctcgctgacctttcttaggttttttttaaacttgaattgtatcatcgggggtagtaaagtytagtagaagatgatgactccaagtgtttttgttatttggatctgcttaagccttttgacggtgtatcatggaatctttctatctcttttggttcagacatgctttagtcggagcattgcctt

SEQ ID NO: 2557 - DNA, 724 bp, Brassica napus
  misc_feature: Ceres CLONE ID no. 956177
  misc_feature: Encodes the peptide sequence at SEQ ID NO. 692
  misc_feature: Encodes the peptide sequence at SEQ ID NO. 1450
aaaaaaaaagagagatctgaatccgtcaaamaaacaaacaaaaaaaaccccaaacgttcgttcacagatctcgagagatgaaaggtggtgaaagcaaagcgcaagcgaagagcactgacgagagattgaagacgagagggaagaaagcagggaagaaggtgaaggatccgaacaagcctaagaggcctccaagtgctttcttcgtcttcctggagggattccgaaaggagttcaatctagctaaccctgacaacaaatccgttggagctgttggtaaagctgctggagccaaatggaaatcaatgactgctgaagataaagctccttatgtagccaaggctgagaccaagaagactgaatacgccaagactatgcaaaaatacaacatgaaattggctaatggaacgagtacagctggagatgatgactctgacaagtccaagtctgaggtcaacgacgaggaagatgctgcaagtgatgaggaggaagatgatgattaaaatgatggatcagcagcagcagtttgtttaattgaagtatcttctcttctgttatgtgttagctttactagttttagggagaaagttgttatgtcttccccccccttttatgttttaactgggattaattcacatctctctacttccaacttcctcatgataactttggatttagctttgaacttcgtttctagttttatgaratggtatccatgtgtttgctt

SEQ ID NO: 2558 - DNA, 694 bp, Brassica napus
  misc_feature: Ceres CLONE ID no. 957098
  misc_feature: Encodes the peptide sequence at SEQ ID NO. 733
actactctctctacttagcaaaaacacacaacaaagtttttttttttttttttttgctaaataacacacaacaaagttggtttacataaagagtaacaagagatggcaattaagtgtttagccgtgttcctcgttgctctcacgggggctcattccgtcaccgccacaagaccggcaccggccaagaatgtcggagctggtcttgaagaccaaaagaactttgttgcgtttgctggcgtcggtggagctgctggagttggtggtgttgggacaggtcttggtggtgtagccggtggagttggtggtgtcgccggagttctacctgtaggtggagtaggcggcggaattggtggtcttggaggtggtgtaggtggtctagggggtggttcgggtctcggtggtggaataggtggtggttcaggtcttggcggcgtaggtggactcggcggtgtaggtggactcggtggtgtaggcggagtcggtggtttgggaggaattgacggtggaagcgattgcggtggcgttytacctcacccttgatattaaaaacgtttttctatataaaccaaagatcgatccaagggtttataatgtttgtatcagttttctaatgttgtaagtttttattttcccgatgttatgtttaagtctttgcttgtttttttcatgctgttttttattaattacttgagat

SEQ ID NO: 2559 - DNA, 881 bp, Brassica napus
  misc_feature: Ceres CLONE ID no. 962327
  misc_feature: Encodes the peptide sequence at SEQ ID NO. 1494
  misc_feature: Encodes the peptide sequence at SEQ ID NO. 1621
gttgcgtgtttgtttgtctctctcatctcgctcacctaaattcgcaaaaaatattctgaacaatattgaacagaaaaccaagaaacccactttttatttcttctccgaaagatcagaaatatattttattttgtcaaatttcgttgaagaagctttgaaattaggggaacaaatttcatttgatctgcacgtttctgatttgagaagaaggagaaaggaacaacaatgagctctgagcaaaacaacagcacaagcttcccaccaactgagccaaaactctgcgacaacggatgcggtttcttcgggtcaccttccaacatgaacctctgttccaaatgctacagaagtctccgagccgaggaagatcaaaccgccgtagcaaaagctgctgtcaagaactcacttaagcttccatcttgcagtctcattatcacaccagagcaaaaacagcctcttgaaaccaaaccagcctctgttgttgtaaccgctgagccgtcttcagttcctatagccacgggacaggaggaggcagagccgtcgaaacctgcgcggacgaacaggtgtttcagctgtaacaagaaggttggagttatggggtttaagtgcaaatgcggtagcacgttttgcgggagccataggtacccggagaagcmcgagtgtagcttcgatttcaaaraagttggacgtgatgcaatcgcaaaggccaatcctgtgatcaaggcggataaagtcgaaaggatatgaaaaatatcmaaccttttctttttataaagtaatttgtggtttctattttcaacttctttggatgtcgatgtgatgtgatcatgttggatgttgggtttytatgaatcataatgaaaattgctgctyttggttttatc

SEQ ID NO: 2560 - DNA, 352 bp, Brassica napus
  misc_feature: Ceres CLONE ID no. 963923
  misc_feature: Encodes the peptide sequence at SEQ ID NO. 836
aaaaagatctgcaaccattgcttcttccaatcgaaacaagagagaagaagtgaacaatgtgctggaggaagagagagagtcgttgtctgcatcaaastatcccgtctcagaaacagctgagtctacagtaggaggaagattgaaacagaaacgtcagcttattaacttggggaagaagcaagttaaaaaggctgaaaaagcaaacaagtgtaaaaagaggaagatggatactgaatctgacgactctgaagctggaacttcgtctcttgtttcagagtttacactcaccataaagaaatcatacgtcctgttcttgggggtaccaaagaggtttgcggagatgcatatgccg

SEQ ID NO: 2561 - DNA, 488 bp, Brassica napus
  misc_feature: Ceres CLONE ID no. 965777
  misc_feature: Encodes the peptide sequence at SEQ ID NO. 226
acacatccttctcttcactgtaaacctttttatctcaatggcgtcccctgatgttgagtaccggtgcttcgttggaggtctagcatgggccaccgacgagagatctctcgagaccgccttctctaagttcggcgaactagttgattccaagatcattaacgatcgtgagactggaagatcaagggggtttgggttcgtcactttcaaggatgagcaatccatgaaggatgccatcgaagggatgaacggacaggatctcgatggtcgcagcatcactgtgaacgaggctcagtcccggggaagcggcggcggcggaggaggccgtggtggcggcggtggataccgcggtggaggtggaggatacggaggtggtggtggttacggaggtggaagacgcgagggtggatacagtggtggcggtggaggtggctactcctcgagaggaggtggtggcggaggatacggtggaggtggctgacgtgagggtg

SEQ ID NO: 2562 - DNA, 621 bp, Brassica napus
  misc_feature: Ceres CLONE ID no. 966126
  misc_feature: Encodes the peptide sequence at SEQ ID NO. 419
atactattgccactaggctgctttgactagagcttgacctcttctcccagtgaaggaacgatcccgctaacgatacagagaaagagggaaatcgarractcgtcagctaaaagaaagattcagcgaagatgagtaccatgaagttctgtcgcgaatgtaataacatcttgtatccgaaggaagacagggagcagtcgatactcctctacgcctgccgtaattgcgatcaccaggaagcagcggatgacaactgtgtttacagaaacgaggttcaccattctgttagtgaacaaactcagatcctctctgacgttgcctctgacccgactcttccccgcaccaaggccgtgcgctgcgccaagtgtcaacacggcgaagctgtcttcttccaggctactgctagaggtgaagaaggaatgactctgttcttcgtttgctgcaaccctaattgtggccatcgctggagagaatagacactagtacttgtttacattgatttcccctctgtaatctgttcttgacttactctgctggaagtgtttcagtttggagttttctgtgtgttcaaataaatatgaatactgtggcggttattctcgatttttcagggtcttttgtgat

SEQ ID NO: 2563 - DNA, 522 bp, Brassica napus
  misc_feature: Ceres CLONE ID no. 973585
  misc_feature: Encodes the peptide sequence at SEQ ID NO. 228
aaacctactacatctccccctctctctcatttcaatggcgtcccctgatgttgagtaccggtgcttcgttggaggtctagcttgggccaccgatgacagagctctcgagaccgccttctctcaattcggcgacgttctcgattccaaggtcggttacacgcagagatcagactcccggaggtttccgatgatctgatcctcatccgatctgtgtttctctgttacttactgttactatgctttgttactgttactttcttattctcaaatcgatcattaacgaccgtgagacgggacaatcaaggggattcggattcgtcaccttcaaggatgagaagtcgatgaaggacgccatcgaggggatgaacgggcaggatctcgacggtcgcagcatcactgtgaacgaggctcagtctcgtggtagcggtggtggcggaggaggccgcggcsgaggcggtggtggataccgcagcggaggcggtggtggttacggaggaggtggtggagggtacggtggaggtg

SEQ ID NO: 2564 - DNA, 932 bp, Brassica napus
  misc_feature: Ceres CLONE ID no. 974951
  misc_feature: Encodes the peptide sequence at SEQ ID NO. 447
ttccttttctcataccccttctttcatcatcttcttccctttctctctcaacattcccattccttccctattccatcgatcttctctacgcttttatatacataactcattatccatccacccttattccctcatctctcaacgttctattttcttctcgaatatcacagaacccgattagatctatagatcttgtttctccagattaggacatcatgtcggaagaacacaggcttcaggagccacggttatgcgctaacgattgcggtttcttcggaaacaccgccacgcagaatctctgctctaaatgttttagagatctaaagcacgaacaggagaactcctccaccgccaaaaacgcccttaagcagactctcgccgcctgtgttgcgtcctcctcsgtatcctcaccgcctcctcctcctcctccagccgatctgacttcagatctgaaagaagtcaacacagagaatccggggaaacgggcagcgagcgagcccgaggaggaggaggagcagaagccgccgcaagatcctaaacgctgtttgacttgccggcggcgcgtggggatcacaggcttcaggtgcaggtgtgggttcgtgttttgtggaacccataggtacgccgagcagcacgagtgcactttcgatttcaagcgggtcgggaaggagaagatcgctaaggcgaatccgattgtgaaagcggagaagctcgagaagatytgaaagaattgtgtttggtgtaaatttatcatcatcaattttaagctttaatttgatttcttctcggtttggttataaaatgatgtgttytcttattagttttcgataattgtttttacaaccattgtttgattgttcagtttagttatcagctatgatattagggaacaatcaaagccattctctcaacgtagctgtgaattttttgct

SEQ ID NO: 2565 - DNA, 1012 bp, Brassica napus
  misc_feature: Ceres CLONE ID no. 975220
  misc_feature: Encodes the peptide sequence at SEQ ID NO. 1979
aaatttgggtatttatcttattttaagactggtcttttcgtgaggttatgaacgtggcagttataggattagtcggactgagaaaaatggggaggaagacgtgggtcgacggcgacgggatgaagaaaggagagtggacggcggaggaagatcaaaaccttgtcgcttacatcaatgagcatggggtctctgattggcgttctctccccaaaagagctggtttgcagagatgtggaaagagctgcaggttaaggtggcttaattacctaaggcctgggattaaaagaggcaaattcactcctcaggaagaagaagagatcatcaaacttcatgctgtcctcggaaacaggtgggcagctattgccaaggagatggataatcgaacagacaacgacatcaagaaccattggaactcttgtctcaagaaaagactgtcgaggaaaggaattgacccgatgacccacgagcctatcatcaataacctcaccgtcacgatcactaacgaagaatgtggtagctcttcaataactacattttctcctacctcatcaccttccggctcggcttgtytcctgaacaagctcgccacaggtatctcatytagacaacatgatctcgacaagattaagagcatcttgctggagccgagaatcgcaagcagtgaccaagatgaaaaagaagaggtaaaaagggatcmcmcgattggtggtggtgaagaaggtgatgattttctgatatgggacgatgaagaagttaggcgttttatggagagtgacgaaatggagtacgggacgacgccgtacgtctctytyttttacgaaagtactcacgtacttgatgacctcctctgactccgttcggttgttaaaaaatgcaagtagcattacaaaatacaagatgaattttagaaaaataagtcgagtccaacgaagactgtttttttttttttgaaactcatatttaattaaaaggaagcagttagttgggtgcattaacagcatccacaacaacc

SEQ ID NO: 2566 - DNA, 987 bp, Brassica napus
  misc_feature: Ceres CLONE ID no. 975672
  misc_feature: Encodes the peptide sequence at SEQ ID NO. 1303
attccatcaacttcagacacacagatctcttctcaatcacattacttctggttctcccaccatgaggaaagggagaggctcttccgccgttccacccgcccttcccggatctgtgaaggagccgaggtacagaggcgttaggaagagaccttggggccgtttcgccgccgagatccgtgaccccttgaaaaaatcccgagtctggctcggcacgttcgactccgcggaggaagccgcacgcgcctacgacgcagccgctcgtaacctccgcggtccaaaggccaagaccaacttccaaatcgactgttctccttcctctcctctccaaccactccatcatcggaaccagatcgatccctttatggaccaccggttatacggcggagagcaggaggttgttatcatcagccggccggcgagtagcagcatgagcagcaccgttaagtcgtgcagcggagtgagaccagcgtcttcttccgtggcgaaggcggcgacgaagagatatccacggactccgccggtggcgccggaggattgccgcagcgactgcgattcgtcgtcgtcggtggttgaagacggasacgacatagcttcgtcgtcttcgcggcggaaaccgccgtttgagtttgatcttaattttccsccgttggatggcgttgacttattcgtaggcgcggacgatctccactgcaccgatctgcgtctttgatctttgagcacaatgacaacaaagatgatgaagaagtgatagggagagagagtttgtgttaagatctgttgttgtaagaaccagatctgtgtttcattcacttgtctgtttcttataaagatcaaacctttgttacatgtaacacttatatagctgctgatgattcttaattattcaaaatccaaagtctgtagaatttatacagtatctatcactgatgtgcttatggatggtttggagtatgaggctacattttcataaatacattcaatgtgtgt

SEQ ID NO: 2567 - DNA, 911 bp, Brassica napus
  misc_feature: Ceres CLONE ID no. 976709
  misc_feature: Encodes the peptide sequence at SEQ ID NO. 527
agattcgtcgaccctttttcggaagcagccgccgcgttttttggttttgacttgtagaaatggtgtttccggagaacaccaactggctcagtgattaccctttgttgattgatggtgttttctctcatcacagtcccactttcccttggcagatcgatggctcagctactactgtcagtgttgaagaagttgatggcttcctttgtgattcggatgtgatcaaagaacctggctcaaagaagagggtcaaatccgaatctaatgctggtcctagctcgaaagcgtgtagggagaaacaaagacgcgataagctaaatgacaaatttacggagttgagttccatactggaacctgggagagctccgaaaacagacaaggttgctatcatcaatgacgctatccggatggtgaatcaagcaagagacgaagcacagagattgaaagacttgaactcaaacctccaggagaaaatcaaggagttgaaggatgagaagaacgagctgcgtgatgagaaacaaaagctgaagactgagaaagacagaatcgagcagcaactcaaagcgatcaacacgcagccttgtttyttaccaaacccgccaacactgtytcaggctcaagctyctggaarcaagcttgtccctttcacaacttaccctggctttgccatgtggcagttcatgccacctgctgcagttgatacctcacaggaccatgtccttygtcctccggttgcttaaaaragcagcatytactattgacggttytccttttytgatgtagacaatcctatgcaaacttgtattgtgatttatggtcatcatgcgattcatttgcatgtaaaatggaaataagcatgcmctaactgtgcaaaatgttgtaaacttttgaaattatggttytacagcttgtgg

SEQ ID NO: 2568 - DNA, 458 bp, Brassica napus
  misc_feature: Ceres CLONE ID no. 976830
  misc_feature: Encodes the peptide sequence at SEQ ID NO. 418
  misc_feature (270)..(270): n is a, c, t, g, unknown, or other
ctagagagcagctgcttggcttgaccttctctactctgaacgatcccgccaaagaacactcgagagagagagactgtgtgtgaaaatcagtgagctgaagagatccagcgaagatgagtacaatgaagttttgtcgcgaatgtaataacatcttatacccaaaggaagacaaggagcaatcgatactcctctacgcttgccgtaactgtgatcatcaggaagcggcggataacaactgtgtgtacagaaacgaggttcatcattcagtangtgaacaaacgcagatcctatccgacgtcgcttctgaccccactcttccccgcaccaaggctgtccgctgcgccaagtgtcaacacggcgaagctgtcttcttccaggctactgctagaggcgaagaaggaatgactctgttcttcgtttgctgcaaccccaattgtggccatcgttggagagaatag

SEQ ID NO: 2569 - DNA, 490 bp, Brassica napus
  misc_feature: Ceres CLONE ID no. 980901
  misc_feature: Encodes the peptide sequence at SEQ ID NO. 690
gtcaaaacaaaaaccctaacgttcacagatctcgaagaagatgaaaggtggtgaaaccaaagctcaatcgaagagcaccgatgaaagattgaaaacgagaggaaagaaagctggaaagaaagcagccaaggatcctaacaagcctaagaggcctccaagtgccttcttcgtcttcctggagggattccgtaaggagttcaatctagctaaccctgacaacaaatccgtcggagctgttggtaaagctgctggagctaaatggaaatcaatgactgatgaagacaaagctccttatgtggccaaggcagagagcaagaagactgaatataccaagactatgcaaaagtacaacatgaaactggctaatggaactagcacagctggagatgatgactctgacaagtccaagtccgaagtcaacgatgaagcagaaggtggaagtgaagaggaggaagatgatgattaggagatggatcagcgagcgatktgt

SEQ ID NO: 2570 - DNA, 951 bp, Brassica napus
  misc_feature: Ceres CLONE ID no. 982579
  misc_feature: Encodes the peptide sequence at SEQ ID NO. 2045
aaaaacactttccaccactttggtcttgacacttcttcaggttcaaacaggaaagagagaaagagaatggcctacagcgcatgcttcttgcacccaagcacacttacctcctccaccgcacggtcatcctccttcccctcgtcccttcaccacgtgtccttctcgagacccgtccatttagtatgcagagctcaacaggctcaagaagaagctaactccgccatctcccgtcgtcttgccctcaccttcctcgtaggtgctgccgccctcggatccaaagtctctcctgctgatgctgcctatggtgaagccgcaaatgtatttggtaagccaaagaagaacacagacttcatgccgtacaatggagaaggattcaaaatagagatcccatcaaagtggaacccaagcaaagaagttgagtatccaggacaagtcctaaggtatgaagacaactttgatgccaccagtaacgtctctgtaatgatcactcctacagacaagaaaaccattgctgattacggttctcctgaacagttcctttctcaggtcagttatctccttggaaagcaagcttacttcggcgagaccgcctttgagggagggtttgatgcaaatgcagtagcaactgccaacattytggagacgtctacacaaraggttggtgggaagaagtactattacttgtcggttttgacaagaacagctgatggagatgaaggtgggaagcatcagcttatcmcagccmctgtgaatggtggaaagctttacatctgtaaagcmcaagcaggagacaagaggtggtttaaaggagctaggaagttcgtcgagaatgctgctacttccttcagtgtcgcttgaaagttgaaactaactatatccaaaacaatattactggaatgttctgttattttgttttcttcttaattgtctcttgtataaaaactatggatc

SEQ ID NO: 2571 - DNA, 1370 bp, Zea mays
  misc_feature: Ceres CLONE ID no. 984060
  misc_feature: Encodes the peptide sequence at SEQ ID NO. 350
accatttcccgggtcacgagtccacggcctcctcgctcgcggtcccgcgccatggcccgcgccaccaacgcccaccaccaccgcctccgcctcctcctctgcctctccctcgcggccgccgcgtgggcgcacggcggaggcggggactccgacgccgacgccgacgcggatgggggcgccgccgccaggccggacctgcgcgcgcgcagcctggtggaggccaagctgtggtgcctggcggtggtgttcgtcggcacgctgctgggcggggtgtccccctacttcatgcgctggaacgaggcgttcctcgcgctgggcacgcagttcgcgggcggcgtcttcctcggcacggcgctcatgcacttcctcagcgacgccaacgagacgttcggggacctgctccccgacagcgggtacccctgggcgttcatgctcgcctgcgccggttacgtcgtcaccatgctcgccgacgtcgccatctcctacgtcgtctcacggtcacaggggcgcagcaccggcaccgccgctaccggcggttctgatgcagggctggaggagggcaagatgagaaccacaaatggcacgaggtctgagcccacaccagctgatgcacacggatctgatcactcggccgcatccattctgcgcaacgcgagcacgatcggtgacagcgtgctgctcatagtagccctttgcttccactccgtcttcgagggcatcgccatcgggatcgccgagaccaaggccgacgcatggaaggcgctgtggaccataagcctgcacaagatcttcgcggccatcgccatgggcatcgcgctgctccggatgctgcccaaccggcccctcctctcctgcttcgcctacgctttcgcgttcgccatctccagccccgttggcgtcggcatcggcatcattatcgacgccaccacgcagggccgggtggccgactggatcttcgccgtctccatgggcctcgccacgggcatcttcgtctacgtctccatcaaccacctcctctccaaagggtaccggccccagaggcccgtcgccgtcgacacgccggtcgggaggtggctcgccgtcgtgttcggcgtggctgtcatcgccgtcgtcatgatatgggacacctgacctggtgagagacacgtagggctgcattgttgggaacttccgggggttgcttattgcacgagagatcgaatatggtgtagcagactctttttagcgttttttagcttactaggagagtgcccgtgcgttgcaacgggaacgtataaaaatacgataaactatgtacaaatgtgtgttatacttttataggtcagtgcccgtgcgttgcaacagagacatataatatcttgataacttat

SEQ ID NO: 2572 - DNA, 475 bp, Arabidopsis thaliana
  misc_feature: Ceres CLONE ID no. 1003147
  misc_feature: Encodes the peptide sequence at SEQ ID NO. 245
acataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgaaaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggctacggaggcggtgatggtggaagttacggaggcggtggtggcggctggtaatcaaagatagagttgtctgcgtgctgctgctctgt

SEQ ID NO: 2573 - DNA, 382 bp, Arabidopsis thaliana
  misc_feature: Ceres CLONE ID no. 1006473
  misc_feature: Encodes the peptide sequence at SEQ ID NO. 1194
atcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactacggaggaggtggtggaggacacggaggtggaggacactacggaggtggtggaggaggatacggaggtggaggaggacaccacggaggaggag

SEQ ID NO: 2574 - DNA, 488 bp, Arabidopsis thaliana
  misc_feature: Ceres CLONE ID no. 1012773
  misc_feature: Encodes the peptide sequence at SEQ ID NO. 190
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggaggatggtaattcctttaattaggtttgggattaccaatgaatgttctctctctcgcttgttatgcttctacttggtbttgtgt

SEQ ID NO: 2575 - DNA, 776 bp, Glycine max
  misc_feature: Ceres CLONE ID no. 1021029
  misc_feature: Encodes the peptide sequence at SEQ ID NO. 446
attccatcgatcttctctacgcttttatatacataactcattatccatccacccttattccctcatctctcaacgttctattttcttctcgaatatcacagaacccgattagatctatagatcttgtttctccagattaggacatcatgtcggaagaacacaggcttcaggagccacggttatgcgctaacgattgcggtttcttcggaaacaccgccacgcagaatctctgctctaaatgttttagagatctaaagcacgaacaggagaactcctccaccgccaaaaacgcccttaagcagactctcgccgcctgtgttgcgtcctcctccgtatcctcaccgcctcctcctcctcctccagccgatctgacttcagatctgaaagaagtcaacacagagaatccggggaaacgggcagcgagcgagcccgaggaggaggaggagcagaagccgccgcaagatcctaaacgctgtttgacttgccggcggcgcgtggggatcacaggcttcaggtgcaggtgtgggttcgtgttttgtggaacccataggtacgccgagcagcacgagtgcactttcgatttcaagcgggtcgggaaggagaagatcgctaaggcgaatccgattgtgaaagcggagaagctcgagaagatctgaaagaattgtgtttggtgtaaatttatcatcatcaattttaagctttaatttgatttcttctcggtttggttataaaatgatgtgttctcttattagttttcgataattgtttttacaacc

SEQ ID NO: 2576 - DNA, 1071 bp, Glycine max
  misc_feature: Ceres CLONE ID no. 1021031
  misc_feature: Encodes the peptide sequence at SEQ ID NO. 1039
gatcgatgaaacccaacccaacccagcccagccccccctctcctccctccctccctcccctcctctccggcctcgcccacgcgccgcttctcgcgcggggagagagagagagagacggacgacgcggagatcgatcgggcgaaggccgccgccgcatcggagcacgcgcgtgcgcgacgacgtccccgcctcgctcggcccgggagttagggcgcgatggcggcgccgccggccagggctcgggccgactacgactacctcatcaagctcctcctcatcggcgacagcggtgttggaaaaagttgtctgctcctacggttctcagatggctccttcaccactagcttcatcacaactattggtatcgacttcaagataaggactgttgagttggatggcaaacggatcaagttgcagatctgggatactgctggccaagagcgctttcggactataactactgcctactacaggggggcgatgggcattttacttgtttatgatgtcacggatgaggcgtcattcaataacataagaaattggatcaaaaacattgaacagcatgcttcagataacgtgagcaaaattttggtggggaacaaagcggatatggatgaaagcaaaagggctgttcccacttcaaagggccaggccctggccgatgaatatggcattcagttctttgaagcgagtgcaaagacaaacatgaatgtcgagcaggttttcttctctatagcaagagacatcaaacagagactctcggaggctgattccaaggctgagggggggactatcaagatcaacacggagggtgatgccagtgcagcagcaggacagaagtcggcttgctgtgggtcttgaaccgtcgtcgtcgctacggggaaaaaagatggttgcgacacggtgcttgtaattcttgtcattccattctttgcctgctggtttcgttgtgttaatttaagttatcgctgttgttaggatttgggcaaatttggtgttgagtcagagcaattactttgcagtatcggtggaatttttttgtttttcttgagatgaaaaaaaaaaaaaaaa

SEQ ID NO: 2577 - DNA, 1019 bp, Glycine max
  misc_feature: Ceres CLONE ID no. 1027529
  misc_feature: Encodes the peptide sequence at SEQ ID NO. 2039
acttttgatgcattatcacactcgacaatcctcaaaaaccactttcatcgcaactcagccagccagagcttaggcgagagagacagagacagaagatggcgtacagcgcgtgtttcctacatcagagcgcactggcctcctccgccgctcgatcatcatcttcctcctcatcccagcgctacgtttcactctccaaacccgtccaggtagtgtgtaaagctcaacagtctcatgaagacgataatcccgccgtctctcgccgtctcgccctcacactcctcgtcggcgccgccgccgttgattccaaagtgtctcctgccgatgccgcctatggtgaagctgcaaatgtgtttgggaagccaaagaaaaacacagacttcacgccatacaatggagatggattccaagtgcaggttccagctaaatggaacccaagcagagaggtagagtatccaggacaagtccttaggtacgaagacaactttgatgctactagcaatctcaatgtcatggtcactcctaccgacaagaagtccatcactgattacggctctcctgaagagttcctctctcaggtcaactaccttcttgggaaacaagcttacttcggtgagactgcctccgagggaggctttgacaacaatgcagtggcaacagcaaacattctggagacaaatgttcaggacgttggtgggaaaccatactactacttgtccgtgttgacaagaacggccgatggagatgaaggtggtaagcatcagctgatcacagccaccgtgaacggaggcaagctttacatctgcaaagcacaagctggagacaagaggtggttcaagggagccaacaaatttgtcgagaaagcagccacttctttcagtgttgcttgaatcaaagcaacacaaacagaacaatgctctgctttctttttttttcatttgtctcttgtaaaaaaatggaaaatgaaactaagcttttgagaaactatcaagatgatgatgatgctaaaaaaaaaaaaaaaa

SEQ ID NO: 2578 - DNA, 684 bp, Triticum aestivum
  misc_feature: Ceres CLONE ID no. 1030653
  misc_feature: Encodes the peptide sequence at SEQ ID NO. 691
aaaaaagagagatctgaatccgtcaaacaaacaaacaaaaaaaaccccaaacgttcgttcacagatctcgagagatgaaaggkggtgaaagcaaagcgcaagcgaagagcactgacgagagattgaagacgagagggaagaaagcaggraagaaggtgaaggatccgaacaagcytaagaggcctccaagtgctttctttcgtcttyctggagggattccgaaaggagttcaatctagctaaccctgacaacaaatccgttggagctgttggtaaagctgctggagccaaatggaaatcaatgactgctgaagataaagctccttatgtagccaaggctgagaccaagaagactgaatacgccaagactatgcaaaaatacaacatgaaattggctaatggaacgagtacagctggagatgatgactctgacaagtccaagtctgaggtcaacgacgaggaagatgctgcaagtgatgaggaggaagatgatgattaaaatgatggatcagcagcagcagtttgtttaattgaagtatcttctcttctgttatgtgttagctttactagttttagggagaaagttgttatgtcttccccccccttttatgttttaactgggattaattcacatctctctacttccaacttcctcatgataactttggatttagctttgaactcc

SEQ ID NO: 2579 - DNA, 431 bp, Brassica napus
  misc_feature: Ceres CLONE ID no. 1033993
  misc_feature: Encodes the peptide sequence at SEQ ID NO. 1786
ttaacaaacacaaacaattatacttcttctctaacccacaacgatcaagaaaagagagtgttctaggattcacatatattccaaatatctgcaagaagtttaaacgaaaatgtcatctagcaggaggtcgagacaagcaagctcatcatcgaggattagcgatgatcagatcactgatcttatctcaaagctccgacaatctattccagagattcgccagaaccgtcgttccagcacggtatcagcatcgaaggtgttacaagagacttgcaattacataagaaacttgaacaaagaagccgatgatctcagtgatcgtctgtctcagcttctggaaaccattgatcctaatagcccacaagcagccattattaggagcttgattaatgaataactacgacatacgcctgattagttgtgctttatatatc

SEQ ID NO: 2580 - DNA, 883 bp, Glycine max
  misc_feature: Ceres CLONE ID no. 1043468
  misc_feature: Encodes the peptide sequence at SEQ ID NO. 1448
ctattgggccgtaccctcttctttagtttccaacagcctttctctctctgcttttgctagtggtactgtcttagctttgattctctgttctctgttttgttctgtttcgcgtattgtcttcatacaggaacttgaacaatgaagaatgcaaagggcaagagagcagcaagggcttcaaaagaatcactgaagcccgttgatgaccgaaaggttggaaagcggaaggcttccggtaagcctgggagaagtagtgcaccaaagaaggagaagaaggccaagaaagaccccaacaagcctaaaagaccacccagtgctttctttgtgttcccttgaggagttcaggaagacctttaaggctgagaatcctaatgtgaaggctgtatcagttgttgggaaagctggaggagagaaatggaaatccttgtccagtgctgagaaagctccatatgaagccaaggctgcgaaaaggaaagctgagtatgaaaaacttatcaaagcttatgataaaaagcaggcaagctccgcagatgatgaagaatcagacaagtccaaatytgaagtgaatgatgaagatgatgccagtggagaggaggaggaagaggatgatgaggaggaagaggacgatgaagatgatgactgagattgatgtccaaaaccttggttatgatgttttgtttgtgaaggaggctattatatattctgattgtgcatactaggctacttttttatatttgtgctggtagaaaagaatttcttcttttgttggcatgatatactctaccaactacttgagcttccctcacttagctatcgtacctgaatcactctttgtgcattgtagccttacatgggttgctttaagtaatataatttctttctgacc

SEQ ID NO: 2581 - DNA, 1355 bp, Glycine max
  misc_feature: Ceres CLONE ID no. 1044034
  misc_feature: Encodes the peptide sequence at SEQ ID NO. 1999
cagttcacaccctagagggagtggatggattttgttgtttttcatataagggcaaagaaagatagaggagctagctagctagcgagcttcaaaactcaaaagcactgacacatacaaacaaaaagatctggctttcataaaattgagataaaagtgcaccgtctccgaatcatgtttataatattatcttcattagatcttgatctcatttttcatctgaaactaaaagaatatatatgtgcctttaccctatttagctatatgcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagttgtgtttgaagac

SEQ ID NO: 2582 - DNA, 975 bp, Glycine max
  misc_feature: Ceres CLONE ID no. 1044385
  misc_feature: Encodes the peptide sequence at SEQ ID NO. 1304
aactgcgtgcactatctcatttctttctattcatttcttcattccaccatcaccatggtcaaggagaagaagaacgtggtggtcaagaacaagaagccaaacaacaatgccgacgagcttcacttccgcggcgtccggaagcgaccatggggccgctacgccgccgagatccgtgaccccggcaagaagacccgcgtctggctcggcaccttcgacaccgccgaggacgccgcccgcgcctatgacgccgccgcccgcaacttccgcggccccaaagccaaaaccaacttccccgtgccccccgacgacaacaacaacaacaacgttaacgtgaacaaaaacaagagtgttaacgttaaatctcacagtcccagccagagcagcaccgtggagtccgccaccccggagcgtgaagccacgcgccgctccacctccgccgcaatcgaccgtttcccgttcctacccatccagcagcaaatcctcatgacccaccccgtcgcagcacccatgcgcccggttttctttctcgaccgggcccacttcatgacccagtctttcccgctccggttcgaacccggtccggtccagagcgactccgactcctcctccgtcgtcgtcgattgtcagcccaaaagagagatcaatctcgatcttaacttggctccgcctaatgaatattaacccttttttttatctctttattttttcataaaaaaagatagcagaaagaaaggactaaggagattttttttctctctttttttttttttggaagattaatcttccattaagaagttaattagtacatcctttgatgtaaataggttgattttctcttcttttttgttttttaggtccttgatagtattatcagaggacatgatctgaaattgtctagatctgatataatttttcatgtaacatctgaatatctgatgtaattctggctaatatcaattaatcttcttttattac

SEQ ID NO: 2583 - DNA, 1040 bp, Glycine max
  misc_feature: Ceres CLONE ID no. 1044645
  misc_feature: Encodes the peptide sequence at SEQ ID NO. 1994
atttttcaactttgcattcgtctagttgtggaatccttcttaatagtactgttttagaattgctaagatgaagtcaagttttgaagaattgaagaagaagaagaagaaaggcgaaggagagcattcgaaggcataaacataaagaaattgaagataatgcgaaccctttgcgacgtatgcgagagcgccgctgccattctcttctgcgccgctgatgaggccgctctctgctccgcttgtgaccacaagatccatatgtgtaacaaacttgctagtaggcatgttcgagttggccttgctgaccccactgatgttccacgctgtgacatatgtgaaaatgcacctgctttcttttactgtgagatagatggtagttcgctgtgtctgcaatgtgatatgattgtgcatgttggtggtaaaagaacccatggaagatatcttctattgaggcaaagagctcagtttccaggtgataaacctgcccaaatggaagaactagagctgcaacctatggatcaaaatgaatcgagaagggatgaaagtcagtcactcaagctaaaaacaagagatagtcagcagaatcacagtgtctcaccttttccaaggcaagaaaataatattgatggtcatggaaaaatggataaaaagttaattgatcttaataccaggccactgcggttaaatggatcagcaccaaacaaccaggaacaatgcatggatattttaagaggcaataatcatgaatctgccagtgtgccaccagtagaatccttcaaacaagagtctgagaagtaacaaaggtacaacatatagggtgtgccagtgtgggcagaggctacagaaatattatgtttactcaaatttcttttacactgttgaccttgtttatgtgaatcttgtttttttttttgcttaaaatttgaattgtttggctgcagacctaattaatgacggaaaatagttgctttcatatggatgagctgcataaacaaggttactactgcataaattcgagggtataacataaattgttgtccagg

SEQ ID NO: 2584 - DNA, 1534 bp, Glycine max
  misc_feature: Ceres CLONE ID no. 1051305
  misc_feature: Encodes the peptide sequence at SEQ ID NO. 111
accttctttatctctcaaaagagagacacaacaaaaggaaccagagtggattaattagggacatgagaacaaggagaggagcgtgttactctggagtagtctcaaggatgtgttccgatgcgagggtttccaagaaaaaaaacaaggatctgcacatgcacatgcatatgcatatgcatgtccccgccggagactccattatttacagccggaaaaggcagaagaaaacgccggagaaaaccgccggcgctgattacgaatttttcgagtctttgccggacgacctcgtaatctccatcttctgcaaacttagttccaccgccactaaaccttccgatttcgtcaatattttaatcacgtgcaaaagattaaacagattagcacttcattcgcttgtattatccaaagcctcgccgaaaactttcactattaaagcaagagattggtgcgattcggcacacaaattcctcaaacactgtgccgatgccggaaacgttgaagcttgctatactttaggcatgattcggttctactgtttgcaaaaccgagggagcggcgcgtcgtttatggcgaaggcggccattaactctcacgcgcgggctctgtatgcgctggccgtgattcagttcaacggcagcggtggcacgaagagcgacaaggacctacgcgccggcgtggcgctgtgcgccagagcggcgtttcttggccacgtcgatgcgatgcgcgaactcggccactgcctgcaggacggttacggcgtgcggcagaacatcgccgagggacggcggttcctcgtgcaggcaaacgcgcgcgagctcgccgccgtgctgtctaccggcgccgccgcgcgcacctggctgagttggaatcttcagccgcagcagctccggcaggggtccgggtgtccgcttctcagcgatttcggatgcaacgtaccggcgccggaggtgcaccccgcgagcctgttcatggcggagtggttcgccgcgcggggcggttcgccgggaccggggctgagactctgttctcacgcggggtgcgggaggcccgagacgaggaagcacgagtttcgaaggtgttctgtgtgcggcgtggtgaattattgctcacgcgcgtgccaagcgcttgattggaagttccggcacaaggcggagtgctcccccgtgcaacggtggctcgaggaggacggcgaagatgtcggtaacgacgacggtgacggagaggtggaggttatggtagatagttagacaatttttacaacagtaacggtaacggaagtcgctttggacggaaaaatgaatatttttggcgaagtgaaagaaaaaaaggaattacttgtgatgatttattcgccgtctcaaaaaggtagaaaagagtatatggcttcttttcttttttccttgtataggtcgaaaattctcccgaaaaaaacgagaggagattatttttctttttttattttattttgcaatttcggagtttaaagttaatttagaaattcaatgctaaaactaagaggttactagttactgct

SEQ ID NO: 2585 - DNA, 385 bp, Triticum aestivum
  misc_feature: Ceres CLONE ID no. 1053672
  misc_feature: Encodes the peptide sequence at SEQ ID NO. 231
acacatccttctcttcactgtaaaccttttatatcaatggccgcccctgatgttgagtaccggtgcttcgttggaggtctagcatgggccaccgatgagaggtctctcgagaccgccttctctaagttcggcgaacttgttgattccaagatcattaacgatcgtgagaccggaagatcaagggggtttgggttcgtcactttcaaggatgagcaatccatgaaggatgccatcgaagggatgaacgggcaggatctcgatggtcgcagcatcactgtgaacgaagctcagtcccgtggaagcggcggaggtggccgtgggggtggcggtggataccgcggtggtggtggtggtggctatggaggcggcggtggtggttacggag

SEQ ID NO: 2586 - DNA, 1573 bp, Glycine max
  misc_feature: Ceres CLONE ID no. 1054168
  misc_feature: Encodes the peptide sequence at SEQ ID NO. 915
atagagcctcctttgtgcgtgtgtgtatatatataagctctctcttgttccttcatcatcacaagaaacaacaagggatttccatggaagtctcaaaagaagaagctcgagtggcacccgcaccggccctagtggcgatgctgccatcccctggcatgggccacctaatcccaatgatcgagttcgcaaagcgagtggtgtgctaccataacctggcggtgagcttcgtgatccccactgacggcccaccttcaaaagcccaaaaggcagttctggaggcccttccggactcaatttcccacaccttcctccctccggtcaatctctccgacttcccgccggacaccaaaatcgaaaccctgatctcccacaccgtcctccgctcccttccttccctccgccaagcattccactccctctccgccacaaacaccctctccgccgtcgtcgtggacctcttctccaccgacgccttcgacgtcgccgccgaattcaatgcctccccctacgtcttctatccctccactgccaccgtcctctccttgttcttccacctccccaccctcgaccagcaggtccagtgcgagttccgagacctcccagaaccggtcagcatccccggttgcattcctcttcccggcaaggacctgttggacccggttcaggaccgcaaaaacgaggcctacaagtggatcctacaccactgcaagcgatacaaagaagccgaggggataatcgggaacagcttcgaggagctcgaaccgggagcctggaacgagctgcagaaggaagaacaagggaggcctccggtttacgcggtgggaccgcttgtaagaatggaagcaggtcaggccgactcggagtgcttgaggtggctggacgagcagccacgtggaagtgttttgtttgtttccttcggaagcggtgggacactctcgagtgcacagatcaacgagctggctctcgggttggaaaaaagtgagcaacggtttctgtgggtggtgaagagcccaaacgaagaaatagccaacgcgacgtacttcagcgccgagagccaagcggatcccttgcagttsctaccggaagggttcgtggagagaacaaaaggaagagggtttttggttcagtcttgggctccgcagcctcaggtattgggccatccatccacgggtgggttcttgacccactgcggctggaactctattctggagagcgtggtgaacggtgtgcctttcatagcctggcctctgttcgcggagcagaggaccaacgcctttatgctcacgcatgacgtcaaggtggcgctgaggcccaacgttgcagagagtggcttggtggagagacaggagatagccagcctagtcaagtgcctcatggaaggtgaacaagggaagaagcttcgttaccgaatcaaggatatcaaggaggctgcggctaaggctctcgctcaacawtggttcctccaccaccaacatctcccaatttggctctcaagtggacccacaaattcaactagtagcttcttcctttcaattatctgcacttaacaaaaaaactgtccctttgcttcctt

SEQ ID NO: 2587 - DNA, 751 bp, Zea mays
  misc_feature: Ceres CLONE ID no. 1060767
  misc_feature: Encodes the peptide sequence at SEQ ID NO. 1462
acaacacacgtacgattcctttcctctgctctcctctctctctctctctctacaaaccctgcgatcctcttcctcaagattcgagtatgaaaggaggtaaatcgaagactgaaaccaggagctccaagctctctgtggctaagaagcctgctaaagcagcaggtcgtagcaaagcggcggctaaggatcctaacaaacctaagaggccagccagtgccttcttcgttttcatggaggactttcgtcagacttacaagaaggatcaccccaacaacaaatctgttgctgctgttggtaaagctggtggagagaagtggaagtcgttgtctgactctgagaaggctcccttcgtagctaaggctgataagcgcaaggttgagtatgagaagaccatgaaagcctacaacaagaagctggaggaaggtccaaaggaggacgaggaggaatctgacaagtctgtgtccgaggtgaatgatgaggatgatgccgatgatggtagtgatgaggaggaagacgatgactaaaagaagttgaagctggtagcacaatataggaacgctacaacaaggatctctcggatgttttttattttctttctttttactgatgttttcaacttagtaaaagctgccactatctctctgattatgattctacgggtaatggaaaaagtgtgtgtagaatgtttgaatgggagatatgcacctctatgtaacgatttagcttttttatcattctgaaatatgttatc

SEQ ID NO: 2588 - DNA, 702 bp, Zea mays
  misc_feature: Ceres CLONE ID no. 1060804
  misc_feature: Encodes the peptide sequence at SEQ ID NO. 862
gttctccacgacgcagttcggctgccagacaaaaaccctaaccaccgtcgccgccgccgccgccgccgctcttcctcgagatgggaggcaagtgcccgcaccgcaaggtaaagaagcgccgcctatcccacaagacggctcgccgcggcaagttcctcctgaaggccgacgatgccgtctatgacgagctcgtcaagctggccgaccagggcaaggacgctgaaaccaaggagctccccgtcgatgaggaccttccaggcctgggacagttctactgcctccactgcgatcgctactttgcaagtgaaagcgtgaaggatgatcactaccgctcaaagcgccacaagaaaagggttaaggtaatgtctggaccggccccgcacacgcagcttgatgcagaactcgctgcagggatgggaaagcctgacaacggcctgaagctcatgtccatgtgaaggaacctcttgctggtactggtacttgttccgtgcctttgttgctgccgtacaattgaagctgctttgcscagtaagtaatagcaagagttatagcagacggttttttttttgttgtacgcaagactttcgaagtgggtgtaagttgttttagagtggtggcagagggggggggggggggtgtcaatgcatgtatcatgaaaccatttatcgacccataccagtgatgatgatgatgatgtctcgc

SEQ ID NO: 2589 - DNA, 943 bp, Zea mays
  misc_feature: Ceres CLONE ID no. 1063835
  misc_feature: Encodes the peptide sequence at SEQ ID NO. 2038
aaaaaccactttcatcgcaactcagccagccagagcttaggcgagagagacagagacagaagatggcgtacagcgcgtgtttcctacatcagagcgcactggcctcctccgccgctcgatcatcatcttcctcctcatcccagcgctacgtttcactctccaaacccgtccaggtagtgtgtaaagctcaacagtctcatgaagacgataatcccgccgtctctcgccgtctcgccctcacactcctcgtcggcgccgccgccgttggttccaaagtgtctcctgccgatgccgcctatggtgaagctgcaaatgtgtttgggaagccaaagaaaaacacagacttcacgccatacaatggagatggattccaagtgcaggttccagctaaatggaacccaagcagagaggtagagtatccaggacaagtccttaggtacgaagacaactttgatgctactagcaatctcaatgtcatggtcactcctaccgacaagaagtccatcactgattacggctctcctgaagagttcctctctcaggtcaactaccttcttgggaaacaagcttacttcggtgagactgcctccgagggaggctttgacaacaatgcagtggcaacagcaaacattctggagacaaatgttcaggacgttggtgggaaaccatactactacttgtccgtgttgacaagaacggccgatggagatgaaggtggtaagcatcagctgatcacagccaccgtgaacggaggcaagctttacatctgcaaagcacaagctggagacaagaggtggttcaagggagccaacaaatttgtcgagaaagcagccacttctttcagtgttgcttgaatcaaagcaacacaaacagaacaatgctctgctttctttttttttcatttgtctcttgtaaaaaaatggaaaatgaaactaagcttttg

SEQ ID NO: 2590 - DNA, 432 bp, Brassica napus
  misc_feature: Ceres CLONE ID no. 1065335
  misc_feature: Encodes the peptide sequence at SEQ ID NO. 853
ctttttccgcctcgtcgtctccagcttctcctcgtgtagttttctactctaaatcgagtatataaaagatgggaagatgccctactaggaaggkgaagaagaggcgtttgtcacacaagacagctcgtcgtgacaaattcgaagtcaaaggagacgatttagtgtacactgagctgcgcaaaccagagacggagacaaagcctttggagcttagcgaggacttgcctggaatgggacagttctactgcttacactgcgatcggtacttctgtaatgtgtcggtgagagatgatcattttaagacgaagaaacacaagaagcgtgtgaagttaatgaatggacctgcgccacactcacaactcgatgctgatttggccgctggaatgggaatgccagacaatggtccmaagctcatggctgcttgagtttttt

SEQ ID NO: 2591 - DNA, 511 bp, Brassica napus
  misc_feature: Ceres CLONE ID no. 1066463
  misc_feature: Encodes the peptide sequence at SEQ ID NO. 2052
ataatcttgatttcatctctgttattatctgtactcctggagcttcttcttttctgcttttgaaggaacaagaacaatcaagatttgagcttaatggaatcaagaatggaaggagatgtgttttccggatttggagagagataccagatggatggcaaagtgttgcagaatttccaaaagagctttgttcaggttcaagacattttggatcagaaccggcttctgatcaacgagatcaatcagaaccatgagtcaaaacaagcagatcacttgggaagaaacgttggtttgataagagagctcaacaacaatatcagaactgtggcaagtctctatggtgatctctctcactcatttgccaaatccattgatgcttcatcagaaggagaatccactgggaccaacaaccaaaagagatttagatccggttaatattactaaaagaaagatcaatctctctgtttctgtagagtcaatgctaatctgaatatgtattgtgcaacaagacaac

SEQ ID NO: 2592 - DNA, 486 bp, Brassica napus
  misc_feature: Ceres CLONE ID no. 1066826
  misc_feature: Encodes the peptide sequence at SEQ ID NO. 180
aaatcacaaatctctctcacacacccttcgaaacttttaattaagaaaataaaaaatgtctggagaagctgagtaccggtgcttcgtgggaggcctggsstgggccaccgcggatgcggatctagagaggacgttctcccaattcggcgaagtaatcgattccaagatcattaacgatcgcgagactgggagatcgaggggattcggattcgtgactttcaaggatgagaagtcgatgagggatgcgattgtggagatgaacgggaaagagctcgatggacgtactattaccgtcaacgaggctcagtctagaggaagcggtggcggtggaggaggccgtggtggcggtggtggttacagaggaggcggtggtggaggttacggtggaggaggtggttacggaggaggtgggggtggatatggaagacgtgatggaggtggttacggatctggtggtggcggcggatacggtggaagacgtgatgg

SEQ ID NO: 2593 - DNA, 459 bp, Brassica napus
  misc_feature: Ceres CLONE ID no. 1067639
  misc_feature: Encodes the peptide sequence at SEQ ID NO. 462
atcaatgttcctttgagacaaatgctcctccctatcttcttcttcatataaacaacatatcttctcctccatatcttaacaatttcatagcaaaccctaaaactgagaagagagagaaaaaaaatgggtagagggaagatagagataaagaggatagagaacgcaaacaacagagtggtgacgttctcaaagaggaggaatgggttggtgaagaaggccaaagagatcacggttctttgcgatgcaaaagttgctctcatagtctttgcaagtaatggtaagatgactgattattgttgtccttccatggaccttggtgctatgttagaccaataccagaagttatctggcaagaaactatgggatgctaagcatgagaacctcagcaatgagattgacaggatcaagaaagagaatgacaacttgcaacttgagctcaggcacttgaagggggwagat

SEQ ID NO: 2594 - DNA, 481 bp, Brassica napus
  misc_feature: Ceres CLONE ID no. 1068473
  misc_feature: Encodes the peptide sequence at SEQ ID NO. 463
aacaatttctcatagcaagccctaaaacagagaaaagagaactagagagagagaaagatgggaagagggaagatagagataaagaggatagagaacgtaaacaacagagttttgacgttctcaaagaggaggaatgggttggttaagaaggcgaaagagatcacagttctgtgtgatgcaaaagttgctctcatagtcttcgcaagtaatggtaagatgactgattattgttgtccttccatggatcttggtgctatgttggaccaataccagaagttatctggcaataaactatgggatgctaagcatgagaacctcagcaatgagattgataagatcaaaaaggagaatgatagcttacaactggagctcaggcatttgaaaggggaagatatacagtctctcaacttaaaaaacctgatggccgtagagcatgccgttgaacatggcctcgacaaagtccgagaccaccagatggagt

SEQ ID NO: 2595 - DNA, 464 bp, Glycine max
  misc_feature: Ceres CLONE ID no. 1075035
  misc_feature: Encodes the peptide sequence at SEQ ID NO. 188
  misc_feature: Encodes the peptide sequence at SEQ ID NO. 223
atcacaccttccctctcttcactgtaaacctactacatctccccctctctctcatttcaatggcgtcccctgatgttgagtaccggtgcttcgttggaggtctagcttgggccaccgatgacagagctctcgagaccgccttctctcaattcggcgacgttctcgattccaagatcattaacgaccgtgagacgggacgatcaaggggattcggattcgtcaccttcaaggatgagaagtcgatgaaggacgccatcgaggggatgaacgggcaggatctcgacggtcgcagcatcactgtgaacgaggctcagtctcgtggtagcggtggtggcggaggaggccgcggcggaggcggtggtggataccgcagcggaggcggtggtggttacggaggaggtggtggagggtacggtggaggtggtggaagacgcgagggtggatacrgtggtggcggtggtggt

SEQ ID NO: 2596 - DNA, 1127 bp, Glycine max
  misc_feature: Ceres CLONE ID no. 1076158
  misc_feature: Encodes the peptide sequence at SEQ ID NO. 1036
aaaaaaacacaagcctgttctccccagatcccctcctcgtccccgattcgattcgattccccgcatcggccggtaccaatccggcgcccgccaccccacactccgccgatgttcctccgatcgcgccgcctgtgatcaccccgctctcttctctctcgccagctcagccagccgccggttaggatcggggccgggggagcgcgatggccgcgccgccggctagggcccgcgccgactacgactacctcatcaagctcctcctcatcggcgacagcggtgttggcaagagttgcctcctcctacggttctctgatggctccttcactactagttttattactacaataggtattgacttcaagataagaacaattgaactggatggcaagcgcattaagttgcaaatttgggatacagccggtcaagagcgattcaggactatcacgacagcatactaccggggagccatgggaatcttgcttgtttatgatgtcacggatgagtcatctttcaacaacatacggaactggatacgcaacattgagcaacatgcctctgataatgtgaacaaaattttgataggcaacaaggctgatatggatgagagtaaaagggctgtttctactgcaaagggacaagcactagcggatgaatatggcatccagttctttgaaactagtgccaagacaaacctcaatgttgagcaagttttcttttccattgcccgagatattaagcagaggcttgctgagactgattccaagcccgaggaccagacgatcaagattaacaagacagaaggttctgagaatccagaatctcagaaatctgcttgctgtggctcatgaggaatacgtggacttctaccatgggctgttttaactttatctgtttattactgtcagcttgttattataggaactgtaagacttaaggagatgactatgttgtggttgttgtgttaccttctatattctttgcagcagcaactattacttttaatgtagtttttgtgatttctaggggtgattgcatgttgtattgccatcgtgagaaccatccacttgctgctgatgtaactgcatttcagtttttcaatcggttggttgctaaaaaaaaaaaaaaaa

SEQ ID NO: 2597 - DNA, 456 bp, Glycine max
  misc_feature: Ceres CLONE ID no. 1076411
  misc_feature: Encodes the peptide sequence at SEQ ID NO. 184
acaagtctctttctctctctctaacctttacttttctccgtctgttagaaaaaaaaatgtctgaagttgagtaccggtgtttcgtcggcggcctagcatgggccaccggagatgctgagctagagaggacgttctcacagttcggcgaagttatcgattcaaagatcattaacgatcgtgagactgggagatcgaggggattcggattcgtgaccttcaaggatgagaagtccatgaaggatgccatcgatgagatgaacgggaaggagctcgacggtcgtaccatcaccgtcaacgaggctcagtccagaggaggcggcggtggaggaggccgtggtggaggtggatacggtggccgtggaggtggtggatacggtggaggcggcggtggatacggtgacagacgtggaggcggcggttacggatctggaggtggcggccgtggaggcggcggtc

SEQ ID NO: 2598 - DNA, 457 bp, Brassica napus
  misc_feature: Ceres CLONE ID no. 1079147
  misc_feature: Encodes the peptide sequence at SEQ ID NO. 732
actactctctctacttagcaaaaagacacaacaaagttggtttacataaagagtaacaagagatggcaattaagtgtttagccgtgttcctcgttgctctcacggtggctcagtccgtcaccgccacaagaccggcaccggccaagaatgtcggagctggtcttgaggaccaaaagaactttgttgcgtttgctggcgtcggtggagctgctggagttggtggtgttggaacaggtcttggtggtgtagccggtggagttggtggtgtcgccggagttctacctgtaggtggagtaggcggcggaattggtggtcttggaggtggtgtaggtggtctcggtggtgttggtggtctagggggtggttcgggtctcggtggtggaataggtggtggttcaggtctcggtggcgtaggtggactcggcggtgtaggtggactcggcggtgtaggcggagt

SEQ ID NO: 2599 - DNA, 600 bp, Brassica napus
  misc_feature: Ceres CLONE ID no. 1079601
  misc_feature: Encodes the peptide sequence at SEQ ID NO. 591
acttttagtttggctgttcgttggacattttatcctctccatctctctcctctttttttctctataaactctcatctctcacatttttttttgcattctccaccaagacctcaaatttcatttaccttattctgactagctcatggataacaccaaccgtcgtcgccgttctaaacaacacaaagtcactctcgaagactctgaagaagtgagcagcatcgaatggaagtttatcaatatgacagaacaagaagaagatatcatccttcgaatgtatagacttgtcggtgataggtgggatttaatagcaggacgagtgccaggaagacagccagaagagattgaaagattctggattatgcgaaacagtgatagctttgctgaaaaacgactgcaacttcaccactcttcctctcataaaaataacaaacttcatcgtccacgtccctctatttacccttcttagttttcagtgtcatttatattttctgcctcacaacaaaaattggtgtaatagttgcagttttatttagcataacgaaaattgtatgtttattttgtcgttttttattttaatgttctaattagtaatcaactatt

SEQ ID NO: 2600 - DNA, 465 bp, Brassica napus
  misc_feature: Ceres CLONE ID no. 1083222
  misc_feature: Encodes the peptide sequence at SEQ ID NO. 189
  misc_feature: Encodes the peptide sequence at SEQ ID NO. 222
accacaccttgcctcttcactgtaaacctactacacctctctcatttcaatggcgtcccccgatgttgagtaccggtgcttcgttggaggtttagcatgggccaccgatgacagagctctcgagaccgccttctcccaatacggcgacgttctcgattccaagatcattaacgatcgtgagacgggacgatcaagggggttcggattcgtcactttcaaggatgagaaggcgatgaaggatgccatcgaggggatgaacgggcaggatctcgacggtcgcagcatcactgtgaacgaggctcagtctcgtggaggcggtggcggaggaggccgcggcggaggcggtggtggataccgcagcggaggcggtggtggttacggaggaggcggtggtggatacggtggaggtggtggaagacgcgagggtggttacagtggcggtggtggaggtggttactcctcgag

SEQ ID NO: 2601 - DNA, 497 bp, Brassica napus
  misc_feature: Ceres CLONE ID no. 1092319
  misc_feature: Encodes the peptide sequence at SEQ ID NO. 229
acacatccttctcttcactgtaaacgttttatctcaatggcggcccctgatgttgagtaccggtgcttcgttggaggtctagcatgggccaccgatgagaggtctctcgagaccgccttctctaagttcggcgaacttgttgattccaagatcattaacgatcgtgagaccggaagatcaagggggtttgggttcgtcactttcaaggatgagcaatccatgaaggacgccatcgaagggatgaacgggcaggatctcgatggtcgcagcatcactgtgaacgaagctcagtcccgtggaagcggcggcggcggaggtggccgtgggggtgggggtggataccgcggtggtggtggtggtggtggctacggaggtggcggtggtggttacggaggcggaagacgggagggtggatacagtggcggtggaggtggctactcctcgagaggaggtggtggcggaggatacggtggaggtggcagacgtgagggtggggg

SEQ ID NO: 2602 - DNA, 479 bp, Brassica napus
  misc_feature: Ceres CLONE ID no. 1099781
  misc_feature: Encodes the peptide sequence at SEQ ID NO. 2051
  misc_feature (433)..(433): n is a, c, t, g, unknown, or other
agagaaaataatattctcgttctccaactgctttctctcatcggagctctctttttctggttctcaaggaaccaaaggacaagattctgagcttggkggaggaggagcctaaagatggaaggagatgtgttctcagggtttggtgagagacacaacatggatggcaaactgctgcagagtttccagaagagctttgtggatgttcaagacattttagaccagaaccggctgctgatcaacgagatcaatcagaaccacgagtccaaacagcctgataacttgggtcgaaacgtcggtctgatcaaagagctcaacaacaatatcagaagagtggctagcctttacggcgacctctctcattcttttgcaagatcgatggatgcttcatcagaaggtgaatctagtggaaccttgaaatctgatggcaaagttnaccagaagaggtttagatccggttagtatatataaccgagagcacc

SEQ ID NO: 2603 - DNA, 901 bp, Glycine max
  misc_feature: Ceres CLONE ID no. 1101577
  misc_feature: Encodes the peptide sequence at SEQ ID NO. 1495
gaatttcttcctcgattttccatttccataaccttagtcatcctcttctttcatctttctccctaacggtaataacaatacaaatctcaatctttctttcttttttctgttttctctgcttttattttagggttttgaaatttgtgatctcaccggtggatcgcttccggtctcgtttcaggtatcgagggaaaaatatggcggaagaacacagatgccaggcaccgcgcttctgcgccaacaattgcggtttctttggcagccctgccacgcagaatatgtgctccaagtgctaccgcgatttccagctcaaggagcagcaatcttccaacgccaagatggttctcaatcagtcgctggttccttcaccgccaccggcggtgatttctcagccgtcgtcttcttcttcggccgcggtagatccgtcatcggcggtggttgatgacgcgccacgcgagtcggaggaggttaaggcgccgcagcagaaccggtgtatgacgtgcaggcggcgcgtggggctcacagggttcaagtgtcggtgcgggatgatgctgtgcgggacccaccgttacccggagcagcacgcgtgcgagttcgacttcaaggggatggggagagagcagatcgcgaaggcgaatccggtggtgaagggcgagaagctcgacaagatctgaaacgaatgaacgaagggtgttatggtaatttcgtgtttatcaagttggtggtgatggataacggatgcgaaacgcgggtcggatcattgacccgtaaaaggcggtgggtgagtgggtgagtttggtgggtcattgttatgtggttgcgttgtcattgtaaattaaaaaatttgaaaaacatttcaattgtcattcaccttctttctggtcgaaaaaaaaaaaaaaaa

SEQ ID NO: 2604 - DNA, 315 bp, Brassica napus
  misc_feature: Ceres CLONE ID no. 1110162
  misc_feature: Encodes the peptide sequence at SEQ ID NO. 181
  misc_feature: Encodes the peptide sequence at SEQ ID NO. 251
tcacaagtctctttctctctctctaacctttacttttctccgtctgttagaaaaaaaaatgtctgaagttgagtaccggtgtttcgtcggcggcctagcatgggccaccggagatgctgagctagagaggacgttctcacagttcggcgaagttatcgattcaaagatcattaacgatcgtgagactgggagatcgaggggattcggattcgtgaccttcaaggatgagaagtccatgaaggatgccatcgatgagatgaacgggaaggagctcgacggtcgtaccatcaccgtcaacgaggctcagtccagagg

SEQ ID NO: 2605 - DNA, 487 bp, Glycine max
  misc_feature: Ceres CLONE ID no. 1113246
  misc_feature: Encodes the peptide sequence at SEQ ID NO. 425
caatccatacactttcctgcaaagggtacggggggatagccagggcatcggctcagctccacgccaagagtagcaaagatctctgatttgatttgagagaggcaagcatcgaatcagccgacaggaggaggtctcagtcaccacccagcagcagccatgagtgccatgaagttttgccgtgaatgcaacaacatcttgtatcccaaggaggacagggaccagaaggtgctcctcttcgcctgcaggaactgcgaccaccaggaggttgcagataacaactgtgtctaccggaacgtggtgcaccacagcgctggagagttcacccaggtgctccaggacgtcgccggcgaccccacccttccccgcaccaaggaagtccggtgtgccgtctgtggccacggcgaagctgtcttcttccaggccaccgcgagaggtgaggaggggatgacgctcttcttcgtctgctgcaacccgagctgcggtcatc

SEQ ID NO: 2606 - DNA, 435 bp, Glycine max
  misc_feature: Ceres CLONE ID no. 1120014
  misc_feature: Encodes the peptide sequence at SEQ ID NO. 179
  misc_feature: Encodes the peptide sequence at SEQ ID NO. 238
aaatctctctcacacacccttcgaaacttttaattaagaaaataaaaaatgtctggagaagctgagtaccggtgcttcgtgggaggcctggcctgggccaccgcggatgcggatctagagaggacgttctcccaattcggcgaagtaatcgattccaagatcattaacgatcgcgagactgggagatcgaggggattcggattcgtgactttcaaggatgagaagtcgatgagggatgcgattgaggagatgaacgggaaagaactcgatggacgtactattaccgtcaacgaggctcagtctagaggaagcggtggcggtggaggaggccgtggtggcggtggtggttacagaggaggcggtggtggaggttacggtggaggaggtggttacggaggaggtgggggtggatatggaagacgtgatggaggtggt

SEQ ID NO: 2607 - DNA, 1178 bp, Glycine max
  misc_feature: Ceres CLONE ID no. 1121989
  misc_feature: Encodes the peptide sequence at SEQ ID NO. 663
ataagtggtatagtctaggccaattcatttcactatcttctttttctccctcttctgtttccatttgagtctcctactagcacacagattattgagatccaaagatcttaactatatggtggcaagaagaatctaaagagaaacaaccaaagcttaagcaaacagtcttgtctactgttgaaaaacaggagaaaatgtcttgtaataatggaatgtcttttttcccttcaaatttcatgatccaaacctcttacgaagatctacctccttctctttcacctctccttccttcttgctctatacctcaagatcttcatgggtttgcttcgtttctaggtaagcgatctccagtagaagggttagaagctgggaacattatgaacggagaagaggattattcagatgatgggtctcaaatgggagagaagaagaggagattgaacatggagcaagtgaagacattagagaagaacttcgagcttggaaacmagcttgacccagagaggaaaatgcagttggctcgtgccttgggtttacagccaagacagatagcgatttggtttcagaacagaagagctcgctggaaaacaaagcagcttgagaaagattatgatacacttaaacgacagtttgattcccttaaagctgaaaacgatcatcttcaaactcacaaccagaaactccaagctgagataatgagttcaaggaacagagaacaaacagawtcaataaatctgaacaaagaaacagaagggatcttgcagtaacagaagcgacaacagttccgataatttcaggctggacatctcgacggctgtgccatcagtagacagcacaataacaggcggccatccaccagcgccacagactgttggtcgacacttctttccacaccagcgaccgcgacgaccaccacaacgactatgcaattctttcaaaactcgtcttctggtcagagtatggttaaagaagaaaacagtatcagtaacatgttctgtgcaatggatgaccactcaggtttttggccatggcttgatcagcaacagtacaactgaaactggtcgacctgtttttatttctttcaaagtttttatatattttgttttgtttttttgttttgatatcagaaagaacatgcatgtttcaaaaacttggaatctatcattcacttktgagtt

SEQ ID NO: 2608 - DNA, 478 bp, Brassica napus
  misc_feature: Ceres CLONE ID no. 1128644
  misc_feature: Encodes the peptide sequence at SEQ ID NO. 467
  misc_feature (118)..(118): n is a, c, t, g, unknown, or other
aaagccatcctttacgtctctctctctctccccgaccgacgaagatcgccgccggattatctgttcacaactaccgctagttttcgagatcaaccatgaatcctgaatatgactatcntgttcaagcttctgctcattggtgattctggtgttggcaagtcatgcttgcttcttaggtttgctgatgattcctacctggatagctacatcagcaccattggtgttgactttaaaatccgcactgtcgaacaagatggaaagaccatcaaactccagatttgggatacggcaggtcaagagcgtttcagaaccatcactagcagttactacagaggagctcatggcatcattgtgacttatgatgtaacagaccaagaaagcttcaacaatgtcaagcaatggctgaatgaaatcgaccgctacgctagtgagaatgtgaacaagctactggttgggaacaagtgtgatctcacttcac

SEQ ID NO: 2609 - DNA, 284 bp, Arabidopsis thaliana
  misc_feature: Ceres CLONE ID no. 1139782
  misc_feature: Encodes the peptide sequence at SEQ ID NO. 2042
  misc_feature (9)..(9): n is a, c, t, g, unknown, or other
  misc_feature (237)..(237): n is a, c, t, g, unknown, or other
actttggtnttcaggttgcaacaagaaagagaaaaaaagagaatggcgtacagcccgagcttcttacaccagagtgcacttgcctcctctgccggacgatcatcatcttcatcttcatcgtcgtttcgtcatgtgtccctctcgagacccgtccatttagtatgtagagctcaacagtctcaggaaaacaataactctgctgttttccgccgtcttgcccttaccttactcgttggngctgcagccatcggatccaaagtctctcctgcgccgcctatggtgaa

SEQ ID NO: 2610 - DNA, 1340 bp, Arabidopsis thaliana
  misc_feature: Ceres CLONE ID no. 1151902
  misc_feature: Encodes the peptide sequence at SEQ ID NO. 1964
atatctacgccgtctccattgattatttctccgtctcttgaaaaatccgactgacactgacctcaaaactctcctctcactttcgtcgtgaagaagccaaatctcgaatcgaatcagcaccacacatttccatggataattcagctccagattcgttatccagatcggaaaccgccgtcacatacgactcaccatatccactctacgccatggctttctcttctctccgctcatcctccggtcacagaatcgccgtcggaagcttcctcgaagattacaacaaccgcatcgacattctctctttcgattccgattcaatgaccgttaagcctctcccgaatctctccttcgagcatccttatcctccaacaaagctaatgttcagtcctccttctctccgtcgtccttcctccggagatctcctcgcttcctccggcgatttcctccgtctttgggaaattaacgaagattcatcaaccgtcgagccaatctcggttctcaacaacagcaaaacgagcgagttttgtgcgccgttgacttccttcgattggaacgatgtagagccgaaacgtctcggaacttgtagtattgatacgacgtgtacgatttgggatattgagaagtctgttgttgagactcagcttatagctcatgataaagaggttcatgacattgcttggggagaagctagggttttcgcatcagtctctgctgatggatccgttaggatctttgatttacgtgataaggaacattctacaatcatttacgagagtcctcagcctgatacgcctttgttaagacttgcttggaacaaacaagatcttagatatatggctacgattttgatggattctaataaggttgtgattctcgatattcgttcgccgactatgcctgttgctgagcttgaaagacatcaggctagtgtgaatgctatagcttgggcgcctcagagctgtaaacatatttgttctggtggtgatgatacacaggctcttatttgggagcttcctactgttgctggacccaatgggattgatccgatgtcggtttattcggctggttcggagattaatcagttgcagtggtcttcttcgcagcctgattggattggtattgcttttgctaacaaaatgcagctccttagagtttgaggtgcagatgtgaagtgatcaataaggattttagcatagacccgtataatcgtcatgtgcgtaagtaggtttggtttgcgctccctctcgcttttaggtccgcaatgactctgtatctatctgattgtaactaaaactgaattcatttgatgaaccaaatgatactattatcttatgttgtgc

SEQ ID NO: 2611 - DNA, 1946 bp, Zea mays
  misc_feature: Ceres CLONE ID no. 1158508
  misc_feature: Encodes the peptide sequence at SEQ ID NO. 154
acggcgaccgatgccgctgctgctgcgcggcgcctccctcctccgcctctgccagtgtaccagtgggctctcaagtgtgaaatttagttcaagagtaacggtactagtgaatctcaacgccatgagggacggaatgcgggccacatattcacgtagagctgaggtcaagaaagatgagcagccactcacagagaaggaagatgctgctgaaagtgatttggagatggagcgagggaggagcagcagccctagccagctccaatcaatgactgtcaaggagctcagggagctcacgaggaggaggggtatttctgtgaaaggtaccaagaaagatttagtatcagcactgatgaattctatggccgtggaagcaaatggtgaagagggaaagtcatccgttgagctggttagccccttggaagtacctttgaaaagaaaaggtggtgcttctgttgtggttgaacaaaaactagaaagttctgagattatttctgaaacacctaacaagaaaagaagtagaacaaaacaaaaatcaagcaagaacaccacttgtcaggaaatttcggtgactaatgtcaagctaagtaagactgttgtccagaaggaaacagttgacggattaagtcctgatgatgattcagagccttggactatactcgtgcataagaaaccagaagccagctggattccatacaaccctaggactatgaggcctccacctcttagcaaggatacacgggctctgaagattatgtcatggaatgtcaatggattgaaagcattgctcaaatcaagaggcttctctgtgcagcagttagcacagagggaggactttgatgtgctttgcttacaagaaacaaaaatgcaggagaaggatattgaagttattaaggacactttgcttgatggctacacaaatagtttctggacttgcagtgtgtcaaagcttggctattctggcactgcaataatttcaagagtcaaaccactgtcgatcaagtatgggcttggtataccagaccatgatactgaagggagggttgtgactgtagagtttgatgacttctacctgttaactgcttatgtaccaaactctggtgatggtctaaaaagattgacttacagggtcacagagtgggatccatcccttggtaactacatgaaagaattggagaaatcgaagcctgtcatactaaccggtgatcttaattgtgcgcatcaggagattgatatacatgaccctgctggaaatcgtagaagtgctggcttcacaaacgaggaaagagaatcatttgggaccaattttttgtccaaagggttcgttgatacgtttcggaaacagcatcctaatgttgttgcctatagttactgggggtacagacataatgcccggaagacaaacaaaggttggcgcctggattactttcttgtgtccgaatcaatcgcagaaaaagtgcatgattcatatattcttccggacatctctgccagtgatcacagtccccttggtctcgtgctgaagctgtaggctgtatcacaggctatgccaaacattcagtctgaagcttgtgccatatttctcagacagcgatgcttattcctgatggtttctggttcgttcagattcctggcaggaacaaggacttttgtcagactattagtgaaacaaggctttgtaatgcactgagcagatttgagactattagtggacaacttactgttagcaaagctgcacctttgtaatgtaaatatgcggccatatcttgtgctgcacttgtgcagctcaatatgagcagcaggggaagctcattacctggtcatggaattatgatactgaccttaacctgttgaggtctttaaactatcttgtcatgtgctgtgccgctgatggcgtcagaaaataactgtgccatgcaatttcacgcaaaaaaaaaaaaaaaaaaaaa

SEQ ID NO: 2612 - DNA, 704 bp, Zea mays
  misc_feature: Ceres CLONE ID no. 1167848
  misc_feature: Encodes the peptide sequence at SEQ ID NO. 1152
gaagagatcagaagaaaccaaagtttggatctttttatagttttcttccaagttttgtttttgttttttcttttgttggagtttccttcttcatatagctataaccatatagctagccatggatatgttttcttctcattccttgtcctataagctaagctctttgtctactgaagcaagtgcctcttctggtaacaacacactcagtaccatccaagaattcagtggctttcacaatgtgatttctagtgtttgtacacacacagagactcacaagcctaagaaaaagagaggccttcctggaaatcctgatccagatgcagaagtgatcgcattatcaccaaagacacttcttgcaacaaacagattcgtttgtgagatatgcaacaaagggtttcaaagagatcagaatctacagcttcacaggagaggccacaatcttccatggaagctgaaacagaagaacaccaaagaacaacaaaagaagaaagtctacgtgtgcccagagacaaactgtgctcatcaccatccatctagagctcttggggatctcacagggatcaagaaacacttttgcaggaaacatggagagaagaaatggaaatgtgaaaagtgttcaaagttctatgctgttcaatctgattggaaagctcataccaagatctgtggtactagagattatagatgtgactgcggcactcttt

SEQ ID NO: 2613 - DNA, 1262 bp, Glycine max
  misc_feature: Ceres CLONE ID no. 1170863
  misc_feature: Encodes the peptide sequence at SEQ ID NO. 512
acttatacacattctattcttcaacaaacattgtagtttgatcaaattcccatggtctctctctctccaattaattcgatttagcttttccccaaatcccaaaccctttctttcgcttagatcccaatccaattgggttatggacatggcttccagtccccgcaccgttgaagagatcttcaaggattacggcgccagaagaactgccgttattcgcgctctcactcacgacgttgatgaattttacggcctctgtgatccagataaggataacctgtgcctctatggacatccaaatgaggcctgggaagtaactctgccagcggaggaagttccgccagagctccctgagcctgctcttggaatcaattttgctagggatggcatgaaccgcagggactggctttctcttgttgctgtgcacagtgattcgtggttggtttctgtggccttttacctcggggctcgtcttaaccgcaatgaaaggaaacgtttatttagcttgatcaatgatcttccatctgtttttgaagttgtgactgacaggaaaccagttaaggacaagccaactgcagatagtggaagcaagtctaggggaagtgccaagagatctagtgatgagcaagttaaaagcaacccaaagtttgtagatgagggttatgaggaggatgaagatgagcataatgaaacactttgtggaagctgtggcggaaattacaatgctgatgagttttggatttgctgtgacatatgtgagaggtggttccatgggaagtgtgttaagattacccctgcaaaggctgagagcataaagcaatataaatgtccatcatgcagcctgaggcggggcaggccatagactgaaggtgatggaatgggtacatgtgaggtgagtgttgtttcgtggttgacaagatactgtaactttgttacatcacttacagaagttcatgtaatgggcatagtattgatgcttaagggcaaatttatcagggattaagtttgtttttaccagatgaacgttgatggatgttacagagtatagaatagagcatggcaaattttaatttgatgattagtttatatttagttgaatatttgcttgaacttacatattgtaatttatttatttatttttaacattgtttaagaagacaaaaccttttcccctccacagattcttctaatcaaactttcattatgctgcttgatgggttaatgaaaagattatgtgagtggattcttgaaaaaaaaaaaaaaaa

SEQ ID NO: 2614 - DNA, 1100 bp, Arabidopsis thaliana
  misc_feature: Ceres CLONE ID no. 1188156
  misc_feature: Encodes the peptide sequence at SEQ ID NO. 1737
gaacaaaaaacaaatcaagcaaatttatttatcttggtcaagagacattgattctcttaaatttctgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttaggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaactt

SEQ ID NO: 2615 - DNA, 2223 bp, Arabidopsis thaliana
  misc_feature: Ceres CLONE ID no. 1209672
  misc_feature: Encodes the peptide sequence at SEQ ID NO. 969
  misc_feature: Encodes the peptide sequence at SEQ ID NO. 976
gagttgcagaaaaaacagaaaaccctcttttctctctcttctctctctctcgaggaagaaaggcaacaactatggaagctatgcttgtggactgtgtaaacaacagtcttcgtcattttgtctacaaaaatgctattttcatgtgcgagcgtctctgcgctgagtttccttctgaggttaatttgcagctattagccaccagctacctgcagaataatcaagcttacagtgcatatcatctgctaaagggaacacaaatggctcagtcccgatacttgttcgcattatcatgcttccagatggaccttctcaatgaagctgaatctgcactctgccctgttaatgaacctggtgcggagatcccaaatggtgcagcaggccattaccttcttggacttatttacaagtatactgatagaaggaagaatgctgctcaacaatttaaacagtccttgacaatagaccctctactttgggctgcatatgaggaattatgtatattaggtgctgctgaggaagcaactgcagtttttggtgaaacagctgctctctccattcaaaagcagtacatgcaacaactgtcaacttccctcggcttaaacacttacaacgaggaacgtaattcaacttctactaaaaacacgagttctgaagattatagtccaaggcagtctaaacacacacaaagccatggccttaaagatatctccggaaatttccattctcatggagttaatggaggtgtttcgaacatgtcattctataatacgccttcgccagtggctgcacagctatccggtatagctccaccaccacttttccggaattttcagccagctgttgcaaacccaaactcccttattactgacagttctccaaagtccactgttaactctactcttcaagcacctagaagaaagtttgtagatgaaggaaagttacgtaagatttctggcagactattttctgattctggtccacgacggagttcaagactgtctgctgattcaggggcaaacattaattcaagtgttgcaacagtaagcggaaatgtgaacaacgcttccaagtatttgggaggttctaaattgagttctttggcacttcgttctgtaacacttcggaagggacactcctgggcaaatgaaaacatggatgaaggggtccgtggggaaccttttgatgattcaaggcctaatactgcctcaacgactggttctatggcttccaatgatcaagaagacgaaacaatgtcgattggtggcatagcaatgagttctcaaacaatcacaattggtgtttcggaaattttaaacctccttaggacactcggagaagggtgtagactttcatacatgtacaggtgtcaggaggcactggatacgtatatgaaacttccacataagcattataatacaggatgggttctttcccaggtcgggaaagcatactttgaactaattgactatttagaggctgaaaaggcattccgtcttgcccgtcaggcttctccttattgcttagaaggaatggatatatactctacggtcctctatcatttgaaggaagacatgaagctgagttacttggctcaggaactaatatcaaccgatcgcttagctcctcaatcttggtgtgctatgggaaattgctatagcttgcaaaaggacaatgagaccgcactgaggaatttcctacgagctgttcaactgaatccaagatttgcatatgcacataccttatgtggccacgaatacacaactcttgaggattttgagaacggaatgaaaagttaccaaaacgcacttcgtgtagatacaagacactacaacgcatggtacgggcttggaatgatatatctacgccaagagaagttagagttctcagagcatcacttcagaatggctttcctaataaacccgagttcctctgttataatgtcttatttagggacatctttgcatgccttgaagagaagtgaagaagcactagagataatggagcaagccatagtagcagatagaaaaaaccctcttccaatgtaccagaaagctaacatacttgtctgcttagaaagattagatgaagctctagaagttcttgaggagctcaaagagtatgcgccttcagagagcagcgtttacgctttaatgggcaggatctataagcggcgaaacatgcacgataaagccatgcttcatttcggtctagctttagawatga

SEQ ID NO: 2616 - DNA, 1940 bp, Zea mays
  misc_feature: Ceres CLONE ID no. 1222684
  misc_feature: Encodes the peptide sequence at SEQ ID NO. 155
acggcgaccgatgccgctgctgctgcgcggcgcctccctcctccgcctctgccagtgtaccagtgggctctcaagtgtgaaatttagttcaagagtaacggtactagtgaatctcaacgccatgagggacggaatgcgggccacatattcacgtagagctgcctctaagaacagtgaggtcaagaaagatgagcagccactcacagagaaggaagatgctgctgaaagtgatttggagatggagcgagggaggagcagcagccctagccagctccaatcaatgactgtcaaggagctcagggagctcacgaggaggaggggtatttctgtgaaaggtaccaagaaagatttagtatcagcactgatgaattctatggccgtggaagcaaatggtgaagagggaaagtcatccgttgagctggttagccccttggaagtacctttgaaaagaaaaggtggtgcttctgttgtggttgaacaaaaactagaaagttctgagattatttctgaaacacctaacaagaaaagaagtagaacaaaacaaaaatcaagcaagaacaccacttgtcaggaaatttcggtgactaatgtcaagctaagtaagactgttgtccagaaggaaacagttgacggattaagtcctgatgatgattcagagccttggactatactcgtgcataagaaaccagaagccagctggattccatacaaccctaggactatgaggcctccacctcttagcaaggatacacgggctctgaagattatgtcatggaatgtcaatggattgaaagcattgctcaaatcaagaggcttctctgtgcagcagttagcacagagggaggactttgatgtgctttgcttacaagaaacaaaaatgcaggagaaggatattgaagttattaaggacactttgcttgatggctacacaaatagtttctggacttgcagtgtgtcaaagcttggctattctggcactgcaataatttcaagagtcaaaccactgtcgatcaagtatgggcttggtataccagaccatgatactgaagggagggttgtgactgtagagtttgatgacttctacctgttaactgcttatgtaccaaactctggtgatggtctaaaaagattgacttacagggtcacagagtgggatccatcccttggtaactacatgaaagaattggagaaatcgaagcctgtcatactaaccggtgatcttaattgtgcgcatcaggagattgatatacatgaccctgctggaaatcgtagaagtgctggcttcacaaacgaggaaagagaatcatttgggaccaattttttgtccaaagggttcgttgatacgtttcggaaacagcatcctaatgttgttgcctatagttactgggggtacagacataatgcccggaagacaaacaaaggttggcgcctggattactttcttgtgtccgaatcaatcgcagaaaaagtgcatgattcatatattcttccggacatctctgccagtgatcacagtccccttggtctcgtgctgaagctgtaggctgtatcacaggctatgccaaacattcagtctgaagcttgtgccatatttctcagacagcgatgcttattcctgatggtttctggttcgttcagattcctggcaggaacaaggacttttgtcagactattagtgaaacaaggctttgtaatgcactgagcagatttgagactattagtggacaacttactgttagcaaagctgcacctttgtaatgtaaatatgcggccatatcttgtgctgcacttgtgcagctcaatatgagcagcaggggaagctcattacctggtcatggaattatgatactgaccttaacctgttgaggtctttaaactatcttgtcatgtgctgtgccgctgatggcgtcagaaaataactgtgccatgcaatttcacgc

SEQ ID NO: 2617 - DNA, 613 bp, Glycine max
  misc_feature: Ceres CLONE ID no. 1247092
  misc_feature: Encodes the peptide sequence at SEQ ID NO. 1820
atactctcatcttctctctctctttttttttccggcataacttgtctgtgattttgaaaaaaaaaaaaaaacctgtctgtgattctaaactccataaactgtttcatcgataactgtcttttgcttcagtatctataactcttgctatttttcgaattaaaattcaaatacaaagaaaatgtcaggaagaagatcacgttcgagacaatcatcagggatctcagaagatcagatcaacgatctcattatcaagttgcagcagcttcttcctgagctcaggaacagccgtcgctccgacaaggtttcagcatcgagagtgttacaagagacgtgcaactacataaggaatctgcatagagaggttgatgatctgagtgagagactttctgagttactcgcaaacacagacactgctcaagctgctttaatcagaagcttacttacccaataatttctatcttcttcttctttattactataataataatagtacgcggattttatttttctctagatgataatgaccttatagatgtttaatgatacaagttcgtcacttctgctttggtcataaatattcgcttgtttcctatataaaacctttgcttttttc

SEQ ID NO: 2618 - DNA, 867 bp, Zea mays
  misc_feature: Ceres CLONE ID no. 1281221
  misc_feature: Encodes the peptide sequence at SEQ ID NO. 1033
gtttccgatctgatctggttccgtgctggtgctagggattgtgaggtaaagcgtgatggcagcgccgccggcgagggctcgagccgactacgactacctaatcaaactgctcctcatcggagacagcggcgttggaaaaagttgcctcctgttacggttttcagatggatcattcaccactagcttcattaccactattggcattgacttcaagataagaactgttgagttggatggcaaaaggattaagttgcagatctgggatactgcaggccaagaacgtttccgcacaattaccactgcctactacaggggagcaatgggcatcttacttgtgtatgatgtcacagacgagtcatctttcaataacataagaaattggatcagaaacattgaacaacatgcttcggataatgtgaacaaaattctggtggggaataaagctgatatggatgaaagcaaacgggctgtgcccacttcaaagggacaagctctcgcagacgaatatgggataaagttctttgaaacgagcgcaaagacaaacctgaacgtcgagcaggttttcttttctatagcaagggatatcaaacagagactttcagagactgattccaagcctgaggatcgaactatcaagatcaaggctgaaggggaagctgatgcagcagaggcgcagaaatcagcttgctgcggctcttgaacggttgtggccgcaggatagtttcataatttttattctttgccagcaagtctctccttgtgcttgagctatcacaattgttgtggtttggacaagtgggtgttacgtcagaactaattacttgctatattgtggaaaccctgctcttgataaaaaaaaaaaaaaaa

SEQ ID NO: 2619 - DNA, 1067 bp, Zea mays
  misc_feature: Ceres CLONE ID no. 1283552
  misc_feature: Encodes the peptide sequence at SEQ ID NO. 2016
aaaaaaatcacccactaaaagcaccttcctcttcctcttcctccgcccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcatttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtccaaacaaaaaaaaaaaa

SEQ ID NO: 2620 - DNA, 1064 bp, Zea mays
  misc_feature: Ceres CLONE ID no. 1290569
  misc_feature: Encodes the peptide sequence at SEQ ID NO. 1038
gatcgagccagggccaggcaacctggtgctccgcccctcgccgttaccgcgacgcttcggcctctggctccaccgcctgcctctgcctgcctccgtggctccgtgacgagacacgacgccgagaggtcacccccacaccgcgccgaggccaccccgcttgggattgtgaggtaaagcgtgatggcagcgccaccggcgagggcccgagccgactacgactacctcatcaaactgctcctcatcggtgacagcggtgttggaaaaagttgtctcctgttacggttttcagatggatcattcaccactagcttcattaccactattggtattgacttcaagataaggactgtcgagttggatggcaaacggattaagttgcagatctgggacactgcaggccaagaacgtttccgcacgattactactgcttactacaggggcgcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcgaaggggcaagctctcgctgacgaatacgggataaagttttttgaaacgagtgcgaagacaaacctgaatgtcgagcaggttttcttttccatagcaagggacatcaaacagagactttcagagaccgattccaagcctgaggatcgaactatcaagatcaaggcagaaggggaagctgaggcagcggcggcggcgcagaattcagcttgctgtggctcctgagcagttgtcaccgcaagatagtggcgttctcgcgcatgtaattttcatcgtttcattctttgccagcgactctctccttgtgcttcttgagctatcgcagttgctgtggcctggacaaatgggtgttaactgttaagtcagagcagttaattgctgtattgtgggaactctacccatggtaaggcgtgcataatggctgtgcaaagtacctttttacactaaaaaaaaaaaaaaaa

SEQ ID NO: 2621 - DNA, 440 bp, Brassica napus
  misc_feature: Ceres CLONE ID no. 1296788
  misc_feature: Encodes the peptide sequence at SEQ ID NO. 1107
aatatttagggtttaaggtttcttgggccggggagggataaaagatggagagcttttgtgagtttcagaaggaagaagagcagatagatcttcctccagggttcaggtttcatccaacagatgaagaactcataactcaatatctccacaagaaggttcttgacatcagcttctcagctaaagctgttggtgaagttgacttcaataagtctgagccatgggagttaccgtggatggcaaaaatgggtgagaaagaatggtacttcttctgtgtgagggacaaaaaatatccaaccggtttgaggacaaaccgggctactgaagccggttattggaaggccaccgggaaagataaggagatttaccgaggtaaatcacttgttggaatgaagaagacacttgtattctatagaggaagagctcctaaaggtcagaaaacc

SEQ ID NO: 2622 - DNA, 680 bp, Brassica napus
  misc_feature: Ceres CLONE ID no. 1303137
  misc_feature: Encodes the peptide sequence at SEQ ID NO. 1137
  misc_feature (17)..(17): n is a, c, t, g, unknown, or other
  misc_feature (22)..(22): n is a, c, t, g, unknown, or other
  misc_feature (631)..(631): n is a, c, t, g, unknown, or other
  misc_feature (634)..(634): n is a, c, t, g, unknown, or other
aaaatcactagctttgngaaanaataaagataacccttataggagaaaactaaataaacaagaaccctaattaattttcttccttttttcttatactcgtattttcattattaacgaccgtcattagattacatatatgtaaaatttggttttctttctatataatgtctttatcaatttcttgatttactcctcatagattaacattgcgagatcttgaatggtaactaactttaatttatcaaatagatcctgatgcggaagtggtagctttatctccaaagacaataatggctacaaacaggttcatatgcgatgtatgcaagaaagggtttcaaagagaacaaaacctacagcttcaccgaagaggacacaatctcccatggaaactcaaacagaagtcaaccaaagaagtaaagaggaaagtctatctttgtccggaacccacgtgcgtccaccatgacccctcacgtgctctcggagacctcaccggaattaagaagcactattaccgtaaacatggagaaaaagaagtggaagtgcgataaatgttctaagcgttacgctgttcaatcggattggaaagctcactctaagacctgtggtactaaaagagtatcgatgtgactgnggnaccatcttctcctagacgcgatagttacattacacaccagggcctt

SEQ ID NO: 2623 - DNA, 432 bp, Brassica napus
  misc_feature: Ceres CLONE ID no. 1306145
  misc_feature: Encodes the peptide sequence at SEQ ID NO. 1111
  misc_feature (395)..(395): n is a, c, t, g, unknown, or other
aaaacttctctgttcatcgttttctctctctccagttataataaatatcttcacataccattctctgaatccatctctcccattaaaaaaatcgttcaagatcaaaaagggtttaaggtttctagaggagagaaaaaaaaatggagacgttttgtggttttcagaaggaagaagagcagatggatttacctccagggttcaggtttcatccaacggatgaagaactcataagtcactatctccacaagaaggttcttgacatcagcttctcagccaaagctattggtgaagttgacttgaacaaatcagaaccatgggagttaccatggatggcaaaaatgggtgagaaagaatggtacttcttctgtgtgagggacagaaaatatccaaccggnttgaggactaaccgggcaactgaagccggttattgga

SEQ ID NO: 2624 - DNA, 1238 bp, Triticum aestivum
  misc_feature: Ceres CLONE ID no. 1315656
  misc_feature: Encodes the peptide sequence at SEQ ID NO. 641
cttttccgacgaggcgacctgccccctttcccctctcgcgcaccttcctctctcgccatggccttcttctcccaccaccacctccagcagccccaccccgcggcgccgccaccgcagcagcagcagcagcagccggcgcctctctccttcaggaacgcgctgccggtgccggtcgatggacagatcccggcgcctctcgccttcttcaacgcgccgcccgctttcccggaccaggccgggcagccacagatagtggacgcggcggggctgacggctgcggcgggtatggggtggaggcagccgagggagcaggagctgctgggggagaactcgcagatgtcgtctatcgatttcctgcagacgggctcggcggtgtcgacgggcctggctctctctctggaggaccggcgccatggcggcggcggcgctggcgcagggaactcctcgggcgattcgccgctgctcctgctgccgatgctggacgacgacatctcccgtgaggtccagcgcctagatgctgatatggaccgattcatcagggcccagagtgagcgcatgaggcagtctatattggagaaagttcaggcaaagcagtttgaagcgctggcctctgttgaagacaagatcctccgaaaaatacgcgataaagagtcagaagtgcagaacatcaacaaaaggaacctggaactcgaggaccagattaaacaaatggcaggggaagttggtgcgtggcagcaacgagctaagtacaacgagagcatgatcagcgcactcaagtacaacctggagcaggtatgtgcccatcagagcaaggacttcaaagaaggctgtggcgacagtgaggtagacgatacagcatcctgctgcaacggcggcgctgtcaatctgcagctgatgcccaaggagaacaatcaccccaaggatttgacggcctgcagggtctgtaaatcaagcgaggcgtgcatgctcttgctgccctgccggcatctttgcctgtgcaaagagtgcgagagcaagctgagcttctgtcccctctgccagtcctccaagatacttggcatggagatatatatgtgatgtagaatataattttatgtactgcttgagtatcttatctttcgagatgctgatgtacttagacatcaatgtattgtcaactgtagtctcactgggtcgataagactgccatttctggtagagttactgcagagaacttctgattaaaaaaaaaaaaaaaa

SEQ ID NO: 2625 - DNA, 1127 bp, Triticum aestivum
  misc_feature: Ceres CLONE ID no. 1322549
  misc_feature: Encodes the peptide sequence at SEQ ID NO. 847
aaatgtccccgggcggcccctcccttcccactccttccttaaacccccataagccttgttcctttcccttctctctagctactcttgcagtcccgctcctcttctccaggcctctccggctccaaacacagacggcgaggagcgccggagctagctgccgtcgcggcgcgccagtgccagtggagtcgagtatcgaagctggagaagtggagatagagcttccgccccctctcggcgttgttgatcaaactgcctctgcagcaggaaaaaaggggcgaacgtacgcatagccagcagcagtagcgggagaggaagatgatgatgactcaagtggccaatcacagcaagaggaaccacaccgacagctacttcagcgggaagcagcagcagcaggccgtcgccaccaccgccaccagcagcggctcggaggagttcgcgggcatggggtccaagaagccgaggaacgccagccccaggggcggcggccccatttctcccagggagaagaaagacaaggtcggcgagagagtggcggcgctgcagcagctcgtgtcgccatttgggaagacggacacagcttctgttcttcaggaggcctcgggctacatcaagttcttgcaccagcagctcgaggttcttagctccccgtacatgcgccctcctccgtcgcccggcgccgagcctgaggatcccgaccactacagcctgcggaaccgcggcctgtgcctggtgccggtggagcagacgctgcagctgacccagagcaacggggccgacctctgggcgccggcgaacaccaccaggcgctgctgaagcgaagcccgaggctggcctcgacggcggcgatggccgcactgcgtggcaggggtagaattccggtacaagcgcgcgcatggctgacccaattcggtcaatctctaacacaatcgtttcgtttcgtttggtttcgtttctgtgaacatcctcagcagaccctgtgctggcgccggtagtatgtaatgtgtaatcgtcgtgtatagcgagacgacgcaccgccgaccgatcggtcgatcggtccccgtggtcgttgcgtgggtgactgtggttaacatggtagcgtcctgttgctgtcaaaaaaaaaaaaaaaa

SEQ ID NO: 2626 - DNA, 1246 bp, Triticum aestivum
  misc_feature: Ceres CLONE ID no. 1329861
  misc_feature: Encodes the peptide sequence at SEQ ID NO. 845
aaaaatgtcccaggccggcccctctctccccactccttccttaaaccccccataagccttgttcctttcccttctctctagctactcttgcagcctcgctcctcttctccagcaggcctctccggctccaaacacgaacggtgaggaggcgccggagcaagctgccgtcgcggcgcgccactgccggtggagtcgagtctcgaagccggagtagtggagatagagcttctgccccctctcggcggcgttgatcctctgcagcaggaaaaaaggggcgaacgtacgcgtagccagcagcagtagcgggggaggaagatgatgatgactcaagtggccaaccacagcaagaggaaccacaccgacagctacttcagcgggaagcagcagcagcagcagcagcaggccggcgccaccaccaccagcggcggctcggaggagttcgcgggcatggggtccaagaagccgaggaacgccagcccccggggcagcggcggccccatttctcccaaggagaagaaggacaaggtcggcgagagagtggcggcgctgcagcagctcgtgtcgccatttgggaagacggacacagcttctgttcttcaggaggcctcgggctacatcaagttcctgcaccagcagctcgaggttcttagctccccgtacatgcgccctcctccggcgcccggcgccgagcctgaggaccccgaccactacagcctgcggaaccgcggcctgtgcctggtgccggtagagcagacgctgcagctgacccagagcaacggggccgacctctgggcgccggcgaacaccaccagacgcacctgaagtgaagcccgaggcaggcctcgacggcggcgatggccgcactgcgtggcaggggtagaattccggtgcaagcgcgcgcatgcgcatggctgacccaattcggtcaatctcctaacacaatcgtttcgtttcgtttatgtgaacctcctcaacaggccctgtgctggcgccggtagtatgtaatgtgtaatcgtcgtgtatagcgagacgacgtaccgccgatcgatggatcgatcggtccccgtggtcgttgcgtgggtgactctgtggtttaacattggtagcgacctgttgctgtcgccgactaatcatcaaaagcagcagtttcattcatgcccgtccgtgctcatcaacccttgtagtactagagagtatcaacatgcggtgcatgcatttgtgcggggtgcgaaaaaaaaaaaaaaaa

SEQ ID NO: 2627 - DNA, 599 bp, Arabidopsis thaliana
  misc_feature: Ceres CLONE ID no. 1338585
  misc_feature: Encodes the peptide sequence at SEQ ID NO. 1988
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
ggcgtcgcgcatttagcgttgttttgaagctctctctttcaaattctgttcgtctctcgcgatctctctctctctcagatagctccgaaactttcacgcagagttaagtgaagcaggatgggattgtcattcgccaagctttttagcaggctttttgccaagaaggagatgagaattctgatggttggtcttgatgctgctggtaagaccaccattttgtacaagctcaagctcggagagattgtaaccaccattcccactattgggttcaatgtggagactgtggagtacaagaacatcagtttcacagtgtgggatgtcggcggtcaggataagatccgtcccttgtggaggcattacttccagaacacccaaggtcttatctttgtggtggacagcaatgacagagaccgtgttgttgaggctagagatgaattgcaccgaatgttgaatgaggacgagctgcgtgatgctgttctgctcgtatttgctnnnnngcaggatctcccaaatgctatgaatgcagctgagatcacggataagcttggtctccactctctccgtcagcgtcactggtacatccagagcacatgtggcac

SEQ ID NO: 2628 - DNA, 1077 bp, Arabidopsis thaliana
  misc_feature: Ceres CLONE ID no. 1344853
  misc_feature: Encodes the peptide sequence at SEQ ID NO. 646
gtctccttctccgtgtccttctctctctctctctcgaagttcatcaatggctcttcatccacaccttcaagactccaagaatttcagagacttttgcggaatcgacggccagatttcgccggaattaggatttaaccgctcagagaatctccatgatcaatctcagcatcctccatatattcctccatttcatgttgctggttttgcaccgggaccggtggttcaaattgatggttctgatggtggtaatggagctgactttgagtggaactatggtcttggtcttgaaccaagacgtgagaggataaaggaacaagatttcttggaaaacaattctcagatatcttctattgattttttgcaagctcggtctgtatcaaccggattgggtctgtctcttgacaatgctcgtgtcgcttcttctgatggctctgcgttgttgtcgcttgttggagacgatattgatcgcgagttacagcggcaagatgcagatatcgataggkttctcaagattcagggggatcagttacggcatgctatcctcgacaagatcaagaggggtcaacagaaaacggtgtcactaatggaggaaaaagttgttcagaaactccgtgagaaagatgaggagctagagaggataaaccgaaagaacaaggaactcgaggtgcgaatggaacagctgacaatggaagctgaggcatggcagcaacgtgcaaagtacaacgagaatatgattgctgcactcaactacaatcttgaccgagctcaaggtcggccaagagatagcattgaaggatgtggagacagtgaagtagatgacacagcttcttgcttcaatgggagagacaacagcaacaataacacgaagacgatgatgatgtgcaggttttgtggagtgagagaaatgtgtatgttgttgttgccatgtaatcatatgtgtttgtgtaaggagtgtgagaggaagcttagctcttgtcctttgtgtcagtcttctaagtttctaggtatggaagtatacatgtgattgtgatttgactaaactaatgtctaattagttaacaaacgaactttatttgt

SEQ ID NO: 2629 - DNA, 608 bp, Arabidopsis thaliana
  misc_feature: Ceres CLONE ID no. 1354021
  misc_feature: Encodes the peptide sequence at SEQ ID NO. 1197
  misc_feature: Encodes the peptide sequence at SEQ ID NO. 1204
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
atcacttacttaacatactaagagagttattacaacttgaaaaacatggcatccaaggctttgattctgttgggtctcttcgcaattcttctggtggtctccgaagtttctgccgcaaggcagtcgggcatggtgaagccagagagtgaggcaactgtgcaacctgaaggttatcacggaggacatggtggtcacggagggggaggccactacggaggaggaggccacgggcatggnnnacacaacggaggagggggccacggacttgacggatacggaggaggacatggaggacactacggaggaggaggaggacactacggaggaggaggaggccacggtggtggtggacactacggaggtggaggacaccatggaggaggaggccacgggcttaacgaacctgttcagacgaaaccaggtgtttaaaagttaaaactataaaataaattcaccaccagtccaccatgcataattgcatctctatatacacttatgtcttataagtatgcatcaaaataaaccatggtgagtttgtaattcagttccttcagaaatgtgtggaataatgttttataataataatagaatatctctcagtttgaatc

SEQ ID NO: 2630 - DNA, 883 bp, Zea mays
  misc_feature: Ceres CLONE ID no. 1360570
  misc_feature: Encodes the peptide sequence at SEQ ID NO. 1622
aacctaaattaagggatttgttctaacaaatctctctagaatccaaaagtaagaatcccgtctctctctcatcttcttctcgggaagatcagaaaacagctttttgtgaaattccatccccaagctttgaagatcgcaggaaaattctcgttttgatctgaccgtttctggtgaagaagacaggattctaaaagacaacaacaatgagctctgagcaaaacaacagcacaagcttcccaccaacagagccaaagctctgcgacaacgggtgcggattcttcgggtcaccctccaacatgaacctctgttccaaatgttaccgaagcctacgtgccgaggaagatcaaaccgcagttgcaaaagctgcggtggagaaatcacttaagcttccatcttgcaatctcatcaccgcaccagagccaaaacagcctctggagaccaaaccagcctcgttggaaaccgttgtgattgctgggacgtcttctgttcctcctgtagctacgggacaggacgagggagagccttcgaaacccacacggccgaacaggtgtttcagctgtaacaagaaggttggagttatggggttcaagtgcaagtgcggtagcacgttttgcgggagccataggtacccggagaagcatgagtgtagcttcgatttcaaagaggttggacgcggtgcaatcgcaaaggcgaatcctgtggtcaaggcggataaagtccagaggatttgatttgatgtgatgtgatctgtctatctttcagtttattccgagaatgttgatgtgatgtggtcatgttccatgttgggtttctatgaatcaaaatgaaaattgctgctattggttttctcatgaatcctttttagtgctttttaagtctattg

SEQ ID NO: 2631 - DNA, 1438 bp, Zea mays
  misc_feature: Ceres CLONE ID no. 1360604
  misc_feature: Encodes the peptide sequence at SEQ ID NO. 887
attacttaacccattttgccaatcaatcactcttcacttcttcccactcctacttttttcctttctaagcaatctctctctctcatactatctgcacagcactactaacagagctatttgctatattgtaaaaggaagatgtttggacaaagcttcgcggaggatcttgattgtggcaacttctttgacaacatggacgatcttcttgattttcccggtggtgatatcgatgtcggtttcggcataggtgactccgactcttttcctaacatctggactactcatcaggacacatggcctgcagcttctgatcctctcttcgcttccaacacaaactctgactcatcacctgagctctatgttccgtttgaagatattgttaaggtggaaagaccaaaatgctttgtagaggaatccttagttgagaagaaggaagattcgtttttcacaaacacggattcatcatcttctcatagccaattcaggagctcaagtccagtgtcggtactcgaaagcagctcctcatcgtctcatacaaccaacacaacctcacttgtcctccctggaaagcacggtcgtccacgcacaaaacgtcctcgtccacaggtccaggagaaagataaagtcaacgacaatgtctttggggcggattcgcgcctcatcattagaataccaaagcagtttctctctgaccacagcaagatgataaccaagaagaagaagaagaaggccaaggttgtttcttcatcttcttggtcggagattgatcttgaaaccaatggaaacaacaatgtagattcgtgttcttcagagcagaatcctgttaggaaatgtatgcactgtgaggtcaccaagaccccacaatggaggctcgggcctatgggcccaaagacgctttgcaatgcttgcgatgtacgttacaaatcgggaaggcttttcccggagtaccggccagctgctagcccaacgtttactccagctcttcactcaaactcccacaagaaggtggctgaaatgagaaacaagagatgcagcaatggaagctacacaaacgaagagaatgatctgcatgatctggttttgaacaatgcctacattggcataggagtaggaaagagtcagagagtagaaaagttttagctttagaagagatggatgaagaggagcaatcaattgaggaaggggtcaaagttagatgagagttgattgtgttgtattttgtattatttgtagtgtgaatgggcaaaactcttgaaacaaaggaagagtaagttggggaagagcagaagattttgaagatactagagagagagttaggtgttgaattttacattaaatcttcctctcctttttcttcctttcaattctttgtacttttattgtgaggattctttttgtagttgatttgtttagctaaattattatttttgtttttgtt

SEQ ID NO: 2632 - DNA, 1810 bp, Zea mays
  misc_feature: Ceres CLONE ID no. 1376400
  misc_feature: Encodes the peptide sequence at SEQ ID NO. 382
tttactccgtccattcacaaagagcgttcatttctgttttctctctcctctcttatttctcttttttccttttttttcttttttttgtttttttttttttttcctctttcgttttttttttctctcttcgttttagttgatttcgaaccctaagctaaaaaggggaaagaggtcttttctcgggaaacaaaacagatatttttccatctcattcatcgcagtgagaaaaaaagatgcagaatccgaggctcaaacaacagcaacaacaacaacaacaacaacaacaagctatgatgcagcaagctttgatgcaacaacaccactctctctatcatcctagccttatggctcctcctccccctcctcctcagatggagcctctaccaagtggaaaccttcctcctggtttcgatcccactacttgccgcagtgtgtatgctggcaacattcacacgcaggtcactgaggttcttcttcaagaaatttttgctagcaccggccctgttgagagctgtaagctcatcagaaaggataagtcatcatatggatttgttcactactttgatcgaagatctgctggtttggctatcatgtctcttaacggcaggcatctgtttggacagcctatcaaagttaattgggcttatgctactggtcaaagggaagacacatcaagccacttcaacatatttgtcggagacctcagtccagatgttactgatgcagctttgtttgagagcttctctgccttcaatacttgctcggatgcaagagtaatgtgggaccagaaaactggacgctcgagaggctttgggtttgtttccttccgcaatcagcaggatgctcaaaatgccataaatgaaatgaatggtaaatggttaagtagcagacaaatcagatgcaactgggcgacaaaaggtgctacttttggcgacgacaaacatagctctgatggcaaaagtgtcgttgaactcacaaacggctcagaggatggtagagagatctcaatcacaaacgaagaagctcctgaaaacaatcctcagtataccactgtgtatgtaggaaaccttgctcctgaagtaactcagcttgatctacaccgcctgttccatacacttggcgctggagtgattgaagaggtccgtgtccagcgagacaaaggctttggttttgtgagatacaatactcatgacgaggctgctcttgctattcagatgggcaactctcagcctttcctcttcaacagacagataaagtgttcatggggaaacaaaccaactccaataggcacagcctcaaacccgcttccaccaccagcgccagtggcagtccctggtctgtccccaatggacctcttagcctatgagaggcaactggctctagccaagatgcatcctcaggctcagcattctcttaggcatgccaatgcagccggagcaagtgctgctatgtacgatggtggttttcagaatgtagctgcggctcatcagcagctcatgtactatcagtaataaactcttggtgccttcgcgctgagataccttttctttctttcttcttaattttatcactttcttgttttcattttctagaccttgttcagagtcttatgtatgtgtctctctctcatttgaagtcgctgattttatatgcatgcttgctggttcgtaccctgagtcttacttggcttgcaagcaagcaataaaataacgttgaaataaaatggagtttggtttgggttctagacatgtttgtctgagagggagtagtagtgtcttgtattgtggttttgtaatggtaaacttggtcc

SEQ ID NO: 2633 - DNA, 1048 bp, Zea mays
  misc_feature: Ceres CLONE ID no. 1376604
  misc_feature: Encodes the peptide sequence at SEQ ID NO. 367
ctccagttgattagatttctcccactttacactttctcccattctccaccgctctgcgacaatgtcggctgctttcattcccatggatcaatctcagaacaacattctcatggattcccagcctactacttcccccgtgaaaactgtgaaaattagcaatgtttcactcaatgtctccaagaaagatctcaatgagttcttttctttctctggtgacattcactacatcgagatgcgcagtgaaacgcaagaaactcagcttgcttatgttaccttcaaggatccacaaggagcagaaactgctatgctcttaacgggagctgtcattgctgatcatcgtgttagtattactcctgctgtgaactacgacctaccaccagaagcccttgcacttgactcgcaggaatattcatttaatggcttcactgtcaagaaagctgaacatgtggtaagcaccatgatggaaagaggttatgctgttggcaaagacgctatggagaaagccaaagcctttgacgacagacacaacctagtctcaaacgcttcagcaaccattgcctccctcgacaacaagatgggtttgagcgagaagctaagcataggaactaccgtggtgaacgaaaagctgagagaggtggacgagcggtatcaagtgagggagatcacaaaatccgctctagcagctgctgaggagagagcgattagcgcaggaacggctttgatggcgaatccttatgtttcaagcggagcttcgtggctatcaaacgcctttggtgcagtgacaaaggcggttagggctgaggatggaggagagggaagaaaggagattgtccaacttgatgacacgtcacctaaagctcctgctgttgttcctgttaactcagtggacacagacttcaccaaaccaagtttctaaagattgtcttaaactccaattctttgatacatttgctgtgcatatacatgcttacatattcattggtctttcttttattgcacaacataaacataacataaaacctttaaaatgtattttgttgttacattc

SEQ ID NO: 2634 - DNA, 795 bp, Zea mays
  misc_feature: Ceres CLONE ID no. 1377336
  misc_feature: Encodes the peptide sequence at SEQ ID NO. 1635
  misc_feature: Encodes the peptide sequence at SEQ ID NO. 1973
attcacaaccacacctctaaacatttctcacaattttttggtctaaagaaggaatataactctttttctcttttcctttttgcttttacacaatcttataagaaactttagcctgagagagcgagagacggtgtaggatgcactacacgcgcatctcaccaattatattgccttctccaccacccaccatcaccgccaccgttgaatccagtggtagaggaaccatgttagccaccctattcatggccctccttctcccttgcgttggcatgtgcattgtcttcctcatatatctcttcttcttgtggtgctccacacgtcgccgtattgagcgtctaagattttctgaaccggttaagctggtcaccggtaaaggtctctctgtctcggagctcgagaaactcccaaaactcaccggaaaagagcttgccttagaagtgaggtcgacagagtgccctgtttgccttgaaaatatcgagagttgccaatcggcccgtctggttcccggttgcaaccatgggtttcaccaattatgtgctgacacgtggttatctaaccacacggtgtgtcctgtttgtcgtggcgatcttgctcagaaggttcctcaacttagtaacaatcatagtccatgttgaaaacatgatcccaaatactcttcttctttattcattttcttctacttgtcttgttttctctctgttaacattttagttttttcatcgtttgctgtagtaggtggatatggtttgtacagtaaattgtaatagagtcaagtacaaaatttcctgttttgtc

SEQ ID NO: 2635 - DNA, 1568 bp, Zea mays
  misc_feature: Ceres CLONE ID no. 1380534
  misc_feature: Encodes the peptide sequence at SEQ ID NO. 888
attactaacccattttcccaatcaatcactcttcacttctcccactcctactcctttttctcctttctaagcaatctctctctctctccttatattctcaaatttgattctctctctctcatacctgcacaccactaccaacagagctaaattgctacactgtaaaaaagaagatgtttggacaaagcttcccggaggatattgattgtggcaacttctttgacaacatggacgacattcttgactttcccggttgtgatatggatgtcggtttcaacatcggtgactccgactctttccctaacatctggaccaatcatcaggacacatggcccgccgcttctgaccctctcttctcttccaacacaaactctgactcatcacctgagctctatgttccgtttgaagatattgtgaaagtggaaaggccagcaagctttgtatcggagtctttggtcgcgaagaaggaagattcgttttccacaaacacggactcatcttcttctcacagccagttcaggagctcaagtccagtgtcggtactcgaaagcagctcctcatcgtctcaaaccaccaacgcaacctcacttgtcctctctggaaagcacggtcgtccacgcacaaaacgccctcgcccaccggttcaggagatggacagagtcaatgtttgcggggcggattcgcgtctcatcgttagaataccaaagcagtttctctctgaccacagcaagatgatcaccaagaagaagaagaagaaggccaaggttacttcttcctattcttcgtcggggattgatcttgaaaccaacggaagcaacaacaacaacaacgttgattcatatgattcagagcagcatccggttaggaaatgtatgcactgtgaggtcaccaagactccacagtggaggcttgggcctatgggtccaaagacgctttttgcaacgcgtgtggcgtgcgttacaagtctggaaggcttttcccggagtaccgtccagctaatagtccaacattcactccagctcttcactcaaactcacacaagaaggtggctgaaatgagaagcaagagatgcagcggtggaagctacacaaacgaagagagtgatctgcaagatttgattccgaacaatgcctacattggtgtggattaagatcgaaaaaagatggttcagtttccaagcgttgaagtgattagagttgcgaggagtaggaaagagtcagtgagcagaaaagttttagctttagaagagatgaatgaagaagagaggatcaagagttagatgaaaagtgattgtgtttgtattttgtatttgtagtgtgtatgtgcaaaactcttgaacacaaaagaagagcagaagattttgaagacactagagaacgttaggttttacattaaatcttcctctccttttcttctttcaattctttgtatttttactgtgaggattctttttgtagttgatttgtttatttttttgtttttgttaaaattttattttattcattagctgcacttaagagcatctccaaaccattgttatttttgcttctattatagcatttagaatc

SEQ ID NO: 2636 - DNA, 1175 bp, Zea mays
  misc_feature: Ceres CLONE ID no. 1384592
  misc_feature: Encodes the peptide sequence at SEQ ID NO. 662
ataagtggtatagtctaggccaattcatttcactatcttctttttctccctcttctgtttccatttgagtctcctactagcacacagattattgagatccaaagatcttaactatatggtggcaagaagaatctaaagagaaacaaccaaagcttaagcaaacagtcttgtctactgttgaaaaacaggagaaaatgtcttgtaataatggaatgtcttttttcccttcaaatttcatgatccaaacctcttacgaagatctacctccttctctttcacctctccttccttcttgctctatacctcaagatcttcatgggtttgcttcgtttctaggtaagcgatctccagtagaagggttagaagctgggaacattatgaacggagaagaggattattcagatgatgggtctcaaatgggagagaagaagaggagattgaacatggagcaagtgaagacattagagaagaacttcgagcttggaaacaagcttgacccagagaggaaaatgcagttggctcgtgccttgggtttacagccaagacagatagcgatttggtttcagaacagaagagctcgctggaaaacaaagcagcttgagaaagattatgatacacttaaacgacagtttgattcccttaaagctgaaaacgatcatcttcaaactcacaaccagaaactccaagctgagataatgagttcaaggaacagagaacaaacagaatcaataaatctgaacaaagaaacagaaggatcttgcagtaacagaagcgacaacagttccgataatttcaggctggacatctcgacggctgtgccatcagtagacagcacaataacaggcggccatccaccagcgccacagactgttggtcgacacttctttccaccagcgaccgcgacgaccaccacaacgactatgcaattctttcaaaactcgtcttctggtcagagtatggttaaagaagaaaacagtatcagtaacatgttctgtgcaatggatgaccactcaggtttttggccatggcttgatcagcaacagtacaactgaaactggtcgacctgtttttatttctttcaaagtttttatatattttgttttgtttttttgttttgatatcagaaagaacatgcatgtttcaaaaacttggaatctatcattcacttttgagtt

SEQ ID NO: 2637 - DNA, 368 bp, Zea mays
  misc_feature: Ceres CLONE ID no. 1385361
  misc_feature: Encodes the peptide sequence at SEQ ID NO. 191
acaccttgcctcttcactgtaaacctactacacctctctcatttcaatggcgtcccccgatgttgagtaccggtgcttcgttggaggtttagcatgggccaccgatgacagagctctcgagaccgccttctcccaatacggcgacgttctcgattccaagatcattaacgatcgtgagacgggacgatcaagggggttcggattcgtcactttcaaggatgagaaggcgatgaaggatgccatcgaggggatgaacgggcaggatctcgacggtcgcagcatcactgtgaacgaggctcagtctcgtggaggcggtggcggaggaggccgcggcggaggcggtggtggataccgcagcggaggcggtg

SEQ ID NO: 2638 - DNA, 1118 bp, Zea mays
  misc_feature: Ceres CLONE ID no. 1385680
  misc_feature: Encodes the peptide sequence at SEQ ID NO. 617
ttctttcgtttcgcctttgatctatagcccctttcgcttttaacttttctctcgatcagctaagtttcgatccattcttgttctcgcttttcaatatcttctcctccttcgcttgattccttctgttctcagatctattcttcgtttgatttcagatctagatctagggtttgttcgaataaaaattgggggaatttgaaaaaagaaggaatgattacagattctctatgagctactcagttcttcttcgtcgtattcgcatagtacactctttctccgtcgtttatctctactacacctacgtcttctcatgaactaatcgtctccgatctcatctcaaataaaacatttctgagttttttttttctttctatacaatctaaccgattctttgatagattagagagcggggaatttaagatctgtgggtaatttatagggatttagaaaaaaaaattatattatttaattttggtgaggaaaaagtcaaaaagtcaacggaaatggggtcgaaaagtcctgattccgacaacgatccgaggtacgcttccgtcacggacgagaggaagaggaagagaatgatctccaacagagagtccgctcggagatcaaggatgaggaagcagaagcagctcggcgatctcatcaacgaggtcactgtgctcaagaacgataacgctaagatcactgagcaggttgatgcggctacgaggaggtacgtggagatggagtccaagaacgatgtcttgagagcgcaagaggtggagctgaaggagaggttgaggtcgttgaactctgtgctggagatggttgaggagattagtggtcaggctttggatattcctgagattcagaacccttggcagattccttgtccgatcatgcaaaccaatcatggtttctgctgatatgtttgaatgcattgtcttgtctgttagagttttgtaacaactagtgtcattggtgtgtgtcgtctttatacaacttcagtctcttgtttttcagttatttcagtttgtgtggtcttgcggttgtcttttattcttatgtcggcttattacataagataaggttgtcatgtatttgtgtttcttaatcaattcaagctttgtgttgtt

SEQ ID NO: 2639 - DNA, 1014 bp, Zea mays
  misc_feature: Ceres CLONE ID no. 1387733
  misc_feature: Encodes the peptide sequence at SEQ ID NO. 532
aaggattctgttttctcacgatgtcatgtctcctctttactctcgttcgaatatcttctgtctagcgaatttcttgtcttcctgttccttgtcttgttattttcattaacagagatccaaatagatggagaagggagagtcaacaagcacgtcttactccgacaccaacggctcaaacgaaccagatcacgacttcgaatgcaacatctgcttcgagttagctcaagaccccatcgtcactctctgcggccacctcttctgctggccttgcttgtaccgttggcttcaccaccactctcactcccaagaatgccctgtctgcaaagctctcgtccaagacgacaagctcgtccctctctacggccgcggcaagaaccagaccgaccctaggaccaaacgttaccccgggatgcggattcccaacaggccagctggtcagagacccgagacggcctctcctcctcctcagcagcctcagaacgacgcggcgagtaactttttcaactacgggattggtttgatgggtgggtttatgcccatggcgactaccaggattgggaacttcagctttggggttggtgggttgttgccttctttgtttaactttcagttccatgggtttcctgacgcggcgctctatggcaccgcgccgggttacccttttggtggttaccataacggtttccgtggagttcctggtggtaacaatgaaccgacggcgcctgttggagggcacccaagcgatgcagctctgaagaatatcctcattgtcgttggaatctgcgtgttcttcttccttttattgtgaaaacagtttgggtttttttttttattatccaggtatgatagttgcaaactctcttacttggtttgaacaatgtcttgtatatacgttacggtaatagcctgagtatgtgtctccttttcctacgtttgttttttgctatttgaagaagattacttggatcttctatacacaactctcgttttttaatcttatttgcttttgacgtg

SEQ ID NO: 2640 - DNA, 970 bp, Zea mays
  misc_feature: Ceres CLONE ID no. 1390343
  misc_feature: Encodes the peptide sequence at SEQ ID NO. 1021
acgtcgggtacatgtttttccgtgatcctcttcttcttcttcttctttctcggcacgattttgtttttgtttaggatgaaagaatgatacaaatgatacaaatgatttgatctctgattcctttttttcgtctcctttagaatcgatggctgctccacctgctaggaccagagccgattatgattatctcattaagcttcttttgattggagatagtggtgtgggtaaaagttgcctacttctacgtttctctgatggctccttcaccactagcttcattaccaccattggcattgactttaagatcagaaccattgagcttgatggcaaacgtatcaaactccagatttgggacactgctggtcaagaacgcttccgcactatcaccactgcttattaccgtggggcaatgggcattttgctagtgtatgatgtcacagacgagtcttccttcaacaacattagaaactggattcgtaatatcgaacaacatgcttctgataatgttaacaagatcttggttggcaacaaggctgacatggatgaaagcaagagggctgtacctgcagcaaagggtcaggctcttgctgatgagtacggaattaagttcttcgaaacaagtgctaagacaaacttaaacgtggaagaagttttcttctcgatagggagggacataaagcagaggctttctgacactgactccaaggcagagcctgcgacgatcaagataagccaaacagaccaggccgatggagccgggcaggccacacagaagtctgcatgctgtggaagttaaaaaaagttgtaaaatcgaagttttaagtcgagaaaaaaaaacgaatatgtccctgctggtgctcgtgcctgttttattccaacatttctgattcgttctaaaatgccttttcctatttgtacgaaggttttaatcgaaacttgtattcttctttttatgttgcttattttctcg

SEQ ID NO: 2641 - DNA, 1142 bp, Zea mays
  misc_feature: Ceres CLONE ID no. 1393778
  misc_feature: Encodes the peptide sequence at SEQ ID NO. 505
cttatgtttatgtcttcttcttctctccatctccttccaaagtctctctctctctctatcgcctttctctctctctctctctccacttccgaccacatcgggtctcagaaacccattgatgcggacctcgatctttctccactagctacagatctacacccttacacaaaccgtatatacatacacactttgtatctctctgtaaaatctatggccgccgtctcctctaaccctcgcaccgtcgaagagatcttcaaggattacaccgctcgtcgctccgccctcctccgtgctctaactaaagatgttgatgatttctactctcaatgcgatccggagaaggagaatttgtgtttgtatggacatccgaatgagtcgtgggaagtgaatctaccggcggaggaagttcctcctgagcttccggagcctgcgcttggtattaatttcgctagagatggtatgcagaggaaggattggctctcgcttgttgctgttcatagtgattgttggttgctctctgtttctttctactttggtgctcgccttaaccgcaacgagaggaagcggttgttcagtctgatcaacgatctcccaactctcttcgatgtagtgactggtaggaaacccatcaaagacaacaagccaagctcagattctggaagcaaatccagaaacggcactaagagatcaatagaagggcagacaaagagtccaacaccaagaccgatggaagagagctacgaggacgaggaagaagaagaagacgagcacggagacactctctgcggtatctgtggaggcaattatacgcaagatgagttctggatttgctgtgatgtttgtgaacgttggtaccatggaaaatgcgtgaagatcacccctgccaaagcagacagcatcaagcagtataaatgccctccttgctgtgcaaagaaaggaagacagtgattatgatcatcatcatcatcatcatctcccagagagactggttctcatgtcttaatattaatcatcctttttcttgtttcattaaccttttaatttcaaagcatacaaaaactctctctttagatcaccggaaagggattccaagaagttgagagagtgtagcaactgtttgagtatttttattcatataagag

SEQ ID NO: 2642 - DNA, 1284 bp, Zea mays
  misc_feature: Ceres CLONE ID no. 1397168
  misc_feature: Encodes the peptide sequence at SEQ ID NO. 788
agatttggttccctcccttatcctattccctcgtgtcatggcgcttctcctgcgcctcgctgctccgtcggtgccgccccggcggagctccggcctcagagcattgccgcgcgtcgtccttccggaggtcgtttccaaacaatcatttcttcgtttactagttgacagcactgcaagtatgccctgtcctattaagtgttctgcggctcggtgtgccccatcattgactgaacacaacgattctaggaataatggcatccatgcatctagtgtatatggacatgatctcatgaagtccatgtctgatctccaggaagttgtattttcctcctttagcaaagcatgtcttctcagtagttgtatcatatatggtctaccacccagttgtatagcagaaccatgtgagcaagaatactttctccctaacatgcctttgctgttcgcaatagccatggttggtgctactgttggagggctccttgcgagacagaggagaggggagcttgcacgtctaaatgatcaattgcgtcagataaatgctgcattgagaagacaagccaagattgaatcttatgctcctgccttgagctatgccccagttggtagcaagataccagaatcagaagttattgttgatcctcagaaacagcgcctaattgcatatctcaggaccggaaagaactatctgagaaaccaagctcctgacaaggcatttcctgagtttaaggcagctcttgatcttgcacgatctttaggtgatcatgttgaagagaagaaggcagcacgaggattaggggcatccttgcaaagacaaggcaagtacaaggaagccataaattatcattccatggtgctaaacatctccaaggtgaccggagaggatgcgggtgtcactgaagcatacggagcaatagcggattgctacaccgagcttggtgagctcgagaaggcaggcaagttctacgacaagtacatagcaagattggagaacgaatgagaaaacagtgctgattggcaaatctgtgagagcagaaacaaagacaaggctaatcatatctctactcttgtcgtcatgtattctactatagatgtgcagttcccagctggaactgatgtttgttatcatgattcaagtttctttttggcagaattatcccagatgtttaggtacagatcagtatcatgctgtgcacgtagttgttttgttaattagggtctcaatggtccgtacaggcattcatgtcaatctgctagttgcgccggcttaattttatagttttgctg

SEQ ID NO: 2643 - DNA, 1009 bp, Zea mays
  misc_feature: Ceres CLONE ID no. 1408748
  misc_feature: Encodes the peptide sequence at SEQ ID NO. 533
ataaaaactaaaaattaagaaatagcgtcgaacgttctctctccctctctcaagtaacagagatccaaatagatggagaagggagagtcaacaagcacgtcttactccgacaccaacggctcaaacgaaccagatcacgacttcgaatgcaacatctgcttcgagttagctcaagaccccatcgtcactctctgcggccacctcttctgctggccttgcttgtaccgttggcttcaccaccactctcactcccaagaatgccctgtctgcaaagctctcgtccaagacgacaagctcgtccctctctacggccgcggcaagaaccagaccgaccctaggaccaaacgttaccccgggatgcggattcccaacaggccagctggtcagagacccgagacggcctctcctcctcctcagcagcctcagaacgacgcggcgagtaactttttcaactacgggattggtttgatgggtgggtttatgcccatggcgactaccaggattgggaacttcagctttggggttggtgggttgttgccttctttgtttaactttcagttccatgggtttcctgacgcggcgctctatggcaccgcgccgggttacccttttggtggttaccataacggtttccgtggagttcctggtggtaacaatgaaccgacggcgcctggtggagggcacccaagcgatgcagctctgaagaatatcctcattgtcgttggaatctgcgtgttcttcttccttttattgtgaaaacagtttgggtttttttttttattatccaggtatgatagttgcaaactctcttacttggtttgaacaatgtcttgtatatacgttacggtaatagcctgagtatgtgtctccttttcctacgtttgttttttgctatttgaagaagattacttggatcttctatacacaactctcgttttttaatcttatttgcttttgacgttgtatctgcatcttatgagaactagttggtgtggaaaataactattgc

SEQ ID NO: 2644 - DNA, 570 bp, Glycine max
  misc_feature: Ceres CLONE ID no. 1416673
  misc_feature: Encodes the peptide sequence at SEQ ID NO. 183
acaagtctctttctctctctctaacctttacttttctccgtctgttagaaaaaaaaatgtctgaagttgagtaccggtgtttcgtcggcggcctagcatgggccaccggggatgctgagctagagaggacgttctcacagttcggcgaagttatcgattcaaagatcattaacgatcgtgagactgggagatcgaggggattcggattcgtgaccttcaaggatgagaagtccatgaaggatgccatcgatgagatgaacgggaaggagctcgacggtcgtaccatcaccgtcaacgaggctcagtccagaggaggcggcggtggaggaggccgtggtggaggtggatacggtggccgtggaggtggtggatacggtggaggcggcggtggatacggtgacagacgtggaggcggcggttacggatctggaggtgcaggatacggtggtggtggtggcagacgtgatggaggtggttacggaggcgctgacggtggctacggaggaggaagtggaggcggtggatggtaatcgaagatgaagtgctgctctgttttcggtttaaacttgc

SEQ ID NO: 2645 - DNA, 608 bp, Zea mays
  misc_feature: Ceres CLONE ID no. 1421639
  misc_feature: Encodes the peptide sequence at SEQ ID NO. 654
atacaatttctgagatatctccgctttggtctctgcttcgtgtcattcttgttgcggatctcgaagagagccccccgtaaatttctcatcgattccgcagagtaaaaaaaaggttcgtttctctagatgggttctccgtcggggcaacccgaatttgattacttgttcaaggttctattgatcggagattctggtgttggcaaaagctctcttttgcttagtttcacttccaatacgtttgatgatctttctcccacaatcggggttgatttcaaggtcaagtaccttaccattggagagaagaaactgaagcttgcgatttgggacacagctgggcaagagagatttaggacgctaacgagctcgtattacagaggagctcagggcatcataatggtatatgatgtgacacgacgagaaacattcaccaatctatcagatatatgggccaaggaaatcgacctctactcgactaatcaggattgcatcaagatgcttgttgggaataaagtcgacaaggagagtgaacgagctgtatctaaaaaagaaggcatagactttgctcgggtgtacggatgtttgtttctggagtgcagtgcmcagactcg

SEQ ID NO: 2646 - DNA, 538 bp, Zea mays
  misc_feature: Ceres CLONE ID no. 1428788
  misc_feature: Encodes the peptide sequence at SEQ ID NO. 1231
ctcgccagtgcccaccccgccagccggcacgaagcgcggcgttaatatctcccctcccttccctcttctggtctccgccccgctccttgcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaaagcagagatgagctccacaggatgctgaacgaggatgagctacgtgatgctgtgctgcttgttttt

SEQ ID NO: 2647 - DNA, 565 bp, Glycine max
  misc_feature: Ceres CLONE ID no. 1432566
  misc_feature: Encodes the peptide sequence at SEQ ID NO. 530
aaaacaaatatgaaaactaaaattaagaaatagcctcgaacgttctctctccctctctcaagatccaaatagatggagaagggggaatcaacaagcacgtcttactccgacaccaacggctcaaacgaaccagatcacgactttgaatgcaacatctgcttcgagttagctcaagaccccatcgtcactctctgcggccacctcttctgctggccttgcttgtaccgttggcttcaccaccactcacactcccaagaatgccctgtctgcaaagctctcgtccaagacgacaagctcgtccctctctacggccgcggcaagaaccaaaccgaccctaggaccaaacgttaccccgggatgcggattccgaaccgaccagctggtcagagacccgagaccgcctctcctcctcctcagcagcctcagaacgacgcggcgagtaactttttcaactacgggattggtttgatgggtgggtttatgccgatggcgacgactaggattgggaacttcagctttggggttggtgggttgttgccttctttgtttaactttcagttccatg

SEQ ID NO: 2648 - DNA, 711 bp, Zea mays
  misc_feature: Ceres CLONE ID no. 1435704
  misc_feature: Encodes the peptide sequence at SEQ ID NO. 734
actacgaactctgcagctcttcttaacaaaaacacacaacaaaattaagttgcaaaaagcgtaacaagagatggcaagtaggtatttagcagtgtttcttgttgctctaacggtggttcaatccgtcaccgccgcaagaccgaccccggccaagaatgtcggagctggtcttgacgaccaaaagaattttgttgcgtttgctggagtcggtggagctgctggagcaggctttggtggtgtagtaggtggcgtcgctggagtgctacctgtaggtggagtaggcggagggattggtggtctcggcggtggtgtaggtggtctcggtggtggaataggaggaattggtggtggttcaggtcttggtggtggtgcaggtgcaggtggactaggcggcgtaggtggactcggcggtgtaggtggcataggcggagttggtggtttgggaggaattggcggtggaagcgattgcggtgacgttcttcctcacccttgatgatataagcgtttattttcattctctcagtaaaccaaaaatcgatcgagaaggtttatatttgttcagtttatcatgttgtttttccaaattttatgttttaagtattttttttatgctgtttgttattagttacttgtgagaaactttttttttgttttgtaacttacttgtgagaaaccttgtgctatcaataaatagagtatttttcgtgtggc

SEQ ID NO: 2649 - DNA, 993 bp, Zea mays
  misc_feature: Ceres CLONE ID no. 1443683
  misc_feature: Encodes the peptide sequence at SEQ ID NO. 1075
caattcgatcacttcttccattccaatttcacacacacgtctcagctcactccctcctccagtttcgtcagctcatcataaaccgaacaggcgaacacagagctctcgattccattccaggatgctgctcaacccggcgtcagaggcgtcggtgctagtcaccatccggcagcacctcctcgaggagccagcggcggcggaggcgcggcctgccgacgagagcttcgggagcctggtggcggaccagtggagtggctccctcccgttccgcaccgacgacgcggacgacatggtggtgttcggggcgctgcaggacgccttcgcctacggctggctgcccgacggctcgttcgtgcacgtgaagcccgagccagtgcggtcccccgactcgtcctcctacccctgctcctacgacggctcatcctgcttcggcctcctcgacccggagccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctaccaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttgggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagctcgtcgtctagccatgcgtgcaacgatggatgcgccggcgaaagcgggggaggga

SEQ ID NO: 2650 - DNA, 1022 bp, Zea mays
  misc_feature: Ceres CLONE ID no. 1444428
  misc_feature: Encodes the peptide sequence at SEQ ID NO. 359
ttttaccaacgattatcttctagttcatggttctcaccttctctcattctccagctcagcttcttccacgaaagtacttgtaaataaatacttaagaaaaatcacaatgggagatacagcagacgaccaagctatggtggaagctcccggagtcccgagcttctcggagcttcttatgttgtctgacgggtttcttagctcctctgaagaccaccgccgcgaaattaacggcggcgatggtggagaagacagcttcggttttgtattctccggtacaagtgggtcaaaaatgctctgtttcagcggagactgccaaaacggcgacgaatcgctcttccaagaaccttcttttccttccggagtatccgtttctgatccttcttcatgcactattaacacttgcaagaactcgaatgacacatgtactgacgagagatcaattaaatcttcaaacaagaagagaaccgggtcgggtaatgggcaaaacatggatcataaccaaaaaccaagcaagaaatgcaagaaaaatcaggataaatcaacagttggaattgcaaaggtaaggaaagaaaggttaggggaaagaattgcagcgttgcagcaattggtttctccatacggaaagacagatgcagcttctgtgctgcatgaagccatgggttacatcaaattcttacaagaccagatccaagtcctttgctctccttacctgatcaactattctcttgacggtggagctgttaccggagatgtaacgccggggaagaaagtgagagacttgagaagcagaggattatgcctagcacccgtctcgtccactgtacacgttgaaaactccaatggtgcggatctatggtcacctgctactgctagtatgggtcacactatgtcaccctctcaatgaatcaagggatattggatttactttcctaggatgatattatcatatagtctttgtttttgatttttgttcaagaactactatttacaaaatttcacccatttctttatgtattttgagg

SEQ ID NO: 2651 - DNA, 567 bp, Zea mays
  misc_feature: Ceres CLONE ID no. 1444599
  misc_feature: Encodes the peptide sequence at SEQ ID NO. 225
acaccttccctcttcactgtaaacctactacatctgtctctctctctctataatctcatttcaatggcgtcccctgatgtcgagtaccggtgcttcgttggaggtctagcatgggccaccgatgacagagctctcgagaccgccttctcccaatacggcgacgttctcgattccaagatcattaacgatcgtgagacgggacgatcaagggggttcggattcgtcactttcaaggatgagaagtcgatgaaggatgccatcgaggggatgaacgggcaggatctcgacggtcgcagcatcactgtgaacgaggctcagtctcgtggaggcggtggcggaggaggccgcggcggaggcggcggtggataccgcagcggaggtggtggtggttacggaggaggcggtggtggatacggtggaggttggtggaagacgcgagggtggttacagtgggcggtggtggaggtggttactcctcgagaggaggtggtggcggtggaggctacggtggcaggcgtgatggtggtgaaggtggaggttacggaggaacggtggtggtggttggta

SEQ ID NO: 2652 - DNA, 878 bp, Zea mays
  misc_feature: Ceres CLONE ID no. 1459729
  misc_feature: Encodes the peptide sequence at SEQ ID NO. 2032
ataacaagatcatcatcagaagatatggggaggtctccatgctgcgagaaagaccacacgaacaaaggagcttggaccaaggaagaagaccagaagctcatctcttacatcaaatctcacggcgaaggttgctggcgttctctccctgcatccgccggccttctccgctgcggcaaaagctgccgtctccgttggattaactacctccgtcctgatctcaagagaggtaacttcaccctcgaagaagacgatctcatcatcaagctacatagcctcctcggcaacaagtggtctcttattgcgacgaggttaccgggaagaacagataacgagattaagaactactggaatacacatatgaagaggaagcttttgagaggagggattgatcccgctactcatcggccgatcaaagctcgtcgggatgcgtctgaagctagagaaacagaggactcgcttgtaaaggttatctctttcggtcctcagctggagaaagaggaaagttctagggaggagggaaggtttaaaaagagtctgacttgcaaaacgaagagcttggatttgaatcttgagctaagaatcagcccgccgtggcaagaccaacaccgacgtgatgagaggaaactcttgtttaggaaagagaagtatctctgcagtgcgtgtcgttttgggttgggaaacggtaaggagtgtagctgtgagaatgtgagatgtcatatagatgactctagtagtagcagctactcttcaagcgacataagtagtagtgttgttggttttgacttcttgggtttaaacactagtagtgtcttggattatactagtttggaaatgaactgaaattaattaaagaaggttgttgaaaaaaaaaaaaaaaa

SEQ ID NO: 2653 - DNA, 496 bp, Zea mays
  misc_feature: Ceres CLONE ID no. 1465358
  misc_feature: Encodes the peptide sequence at SEQ ID NO. 185
  misc_feature (459)..(459): n is a, c, t, g, unknown, or other
aaaatcacaagtctctttctctctctcattatttttctccgttttaaaacaaaaaaatgtctgcagaagtagagtaccggtgcttcgtcgggggcctagcatgggccaccggagatgctgagctagagaggacgttctcacagttcggcgaagttatcgattcaaagatcattaacgatcgtgagactgggagatcgaggggattcggattcgtgaccttcaaggatgagaagtccatgagggatgctatcgatgagatgaacggaaaggagctcgacggacgtaccatcaccgtcaacgaggctcagtctagaggaagcggcggtggaggaggccgtggtggaggtggatacggtggccgtggaggtggtggttacggtggaggcggcggtggatacggtgacagacgtggaggtggaggttacggatctggaggtggcggccgtggaggtggagaanacggtggtggtggtggagacgtgaaggagtgggtacg

SEQ ID NO: 2654 - DNA, 307 bp, Glycine max
  misc_feature: Ceres CLONE ID no. 1467901
  misc_feature: Encodes the peptide sequence at SEQ ID NO. 209
acctccccgtgtcgcgagaaaccctcgtcccttcctctcctctccttccctcccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtccc

SEQ ID NO: 2655 - DNA, 1195 bp, Zea mays
  misc_feature: Ceres CLONE ID no. 1475648
  misc_feature: Encodes the peptide sequence at SEQ ID NO. 1676
agagacgagggacgcacaggccatacatactacattcatgtgctgcgcgcccaaggtggcgaacgcggagggacgagggccctgtcgttgctgcgccggcggtgaggaggacgacgaggacggccagcagccggcagcggcgtggcgaatgctatcggggtacgagcggagccgggaggcgtccatgatggtcgacgcgctggccacggtcgtcgctggcggggcaacgccgccggcaacggccggtgcccgtcagcagcaggtatcgcctgagggccagtggtggagcgactactacgccggagatgtaacgccgccgccctctcttcctgcaccggccgctcacgagcacggagcggcacggattcccgcgacggcggcgtcacccagctctagctcgcaggccccctcgccgtcctccaccggctccggcacgccgcggaggcggtaccgcggtgtgcggcagcggccgtggggtaagtgggcggcggagatccgggatcctcacaaggcggcgcgcgtgtggctaggcaacttcgacaccgcggaggccgccgcccgggcgtacgacgtggcggcgctcaggttccgcggcagccgcgctaagctcaacttcccggagtccgccacgctcgcggcgccaccgccgacggcggcggcggccgcggttcctcctcctccgtcgccgccgccgcagaggcccgaggcgctgctcgagtcgcaggcgctggcgctggcgggtggccgggagtactcagagtacgccaggttcctgcagtgccccgccgatccgccgcgactctacgaccaggcgcctgcggcgaccgtgccctccgcggcgtccggatcggcgtcttcgtcgttcccggtgctcttcagattcggcggaggaggtgagagcagcggcgcggcgagcagtcagtggtggacgcagggcagccgctccgtgagccaagaaggagccggctccccgccggcgagctgggcggactctgcttggtggccggcgcctccgcgggacccgccacgatgacgtccctgtcaggcttgtctctgcaagccaatcctgcagtctgcaccgagcgagtccggattgccagttcgttggcacgtgtaccgattcttttttttgtttcctgcaaaaaaacaaaaaaaaagctttctttgagaggatgtatcaaaaaaaaaaaaaaaa

SEQ ID NO: 2656 - DNA, 726 bp, Glycine max
  misc_feature: Ceres CLONE ID no. 1496331
  misc_feature: Encodes the peptide sequence at SEQ ID NO. 735
acgaactctgcagctcttcttaacaaaaacacacaacaaaattaagttgcaaaaagcgtaacaagagatggcaagtaggtatttagcagtgtttcttgttgctctaacggtggttcaatccgtcaccgccgcaagaccgaccccggccaagaatgtcggagctggtcttgacgaccaaaagaattttgttgcgtttgctggagtcggtggagctgctggagcaggctttggtggtgtagtaggtggcgtcgctggagtgctacctgtaggtggagtaggcggagggattggtggtctcggcggtggtgtaggtggtctcggtggtggaataggaggaattggtggtggttcaggtcttggtggtggtgcaggtgcaggtggactaggcggcgtaggtggactcggcggtgtaggtggcataggcggagttggtggtttgggaggaattggcggtggaagcgattgcggtgacgttcttcctcacccttgatgatataagcgtttattttcattctctcagtaaaccaaaaatcgatcgagaaggtttatatttgttcagtttatcatgttgtttttccaaattttatgttttaagtattttttttatgctgtttgttattagttacttgtgagaaacttttttttttgttttgtaacttacttgtgagaaaccttgtgctatcaataaatagagtatttttcgtgtggcgaaaaaaaaaaaaaaaa

SEQ ID NO: 2657 - DNA, 600 bp, Glycine max
  misc_feature: Ceres CLONE ID no. 1500962
  misc_feature: Encodes the peptide sequence at SEQ ID NO. 531
aagaaatagcgtcgaacgttctctctccctctctcaagtaacagagatccaaatagatggagaagggagagtcaacaagcacgtcttactccgacaccaacggctcaaacgaaccagatcacgacttcgaatgcaacatctgcttcgagttagctcaagaccccatcgtcactctctgcggccacctcttctgctggccttgcttgtaccgttggcttcaccaccactctcactcccaagaatgccctgtctgcaaagctctcgtccaagacgacaagctcgtccctctctacggccgcggcaagaaccagaccgaccctaggaccaaacgttaccccgggatgcggattcccaacaggccagctggtcagagacccgagacggcctctcctcctcctcagcagcctcagaacgacgcggcgagtaactttttcaactacgggattggtttgatgggtgggtttatgcccatggcgactaccaggattgggaacttcagctttggggttggtgggttgttgccttctttgtttaactttcagttccatgggtttcctgacgcggcgctctatggcaccgcgccgggttacccttttggtg

SEQ ID NO: 2658 - DNA, 1677 bp, Zea mays
  misc_feature: Ceres CLONE ID no. 1534695
  misc_feature: Encodes the peptide sequence at SEQ ID NO. 931
aggcaccacaggctgataagcggcagtgggaaaataccgcaccgcacgcaccaatggagaacgccaacgcctcctcttgccgcaacggcgacggcacccagacgccaccgccgcacgtggcgatgcttgcgacgcccgggatgggccacctgatcccgctggcggagctggcgaagcgcctggcccagcgccacggcgtcacgtccacgctcatcacgttcgcgtccacggcgtccgccacgcagcgcgcgttcctcgcctcgatgccgcccgccgtcgcgtccatggcgctgccgccggtggacatgtccgacctcccgcgcgacgccgccatcgagacgctcatgtccgaagagtgcgtgcgcgccgtgccggcgctcaccgaggcgctcctgagcctcaagcagcggcccaccacgaccggccgtctcgtggcgttcgtcaccgacctcttcggcgcggacgcgttcgacgcggcgcgcgcggcgggggtccagcggaggtacctcttcttcccgaccaatctaaccgcgctcacgctgatgctccacctgccggagctcgacgcctcgatccccggcgagttccgggacctcgccgagccgctccgcctgcccgggtgcgtgccgctgccgggcaccgagaccatgaagccgctgcaggacaagtccaaccccagctacagatggatggtgcaccacggcgccaagttccgcgaggcaaccgccatcctcgtcaactccttcgacgccgtcgagccggggcccgccgaggtcctgcgccagccggagcccgggcgaccgccggtgcgcaccatcggcccgctcgtgcgcgcagaggacggtggaggcagcaaggacgacgcgccgtgcccgtgcgtggagtggctggaccggcagccggccaagtcggtcatcttcgtgtccttcggctccggcggcacgctgcccgccgaggagatgcgggagctcgcactagggctggagctcagcgggcagcggttcctgtgggtagtgcggagccccagcgagggcggcgtcggcaacgacaactactacgactcggcgagcaagaaggaccccttctcctacctgccccaagggttcctggagcggaccaaggacgtcggcctcgtggtgccgtcgtgggcgccgcagcccaaggtgctggcgcaccagtccaccggcggcttcctcacgcactgcggctggaactcgacgctggagagcctggtgcacggcgtgcccatgctggcgtggccgctgttcgccgaccagaggcagaacgcggtgctgctgtgcgacggggtaggggccgcgctacgagtgcccggggccaaggggagggaagacatcgccgcggtggtgcgggagctgatgaccgcggagggcaagggcgccgcggtgcgggccaaggtggaggagctgcagaaggccgcggccgagggccttcgcgacggcggcgccaccgcggccgcactggcggaggtggtcaaggagtggacgagtgcagacgacagcgtctactaatcctacactactacgctaaacgcgaatagcctagttaattattcaaagcatttattatgtccattttgctattattgcgggtgcagttattataataaagtgctcgtgtcagagtaaaaaaaaaaaaaaagaaaaaaaaaaaaaaaaa

SEQ ID NO: 2659 - DNA, 551 bp, Zea mays
  misc_feature: Ceres CLONE ID no. 1535974
  misc_feature: Encodes the peptide sequence at SEQ ID NO. 1230
  misc_feature: Encodes the peptide sequence at SEQ ID NO. 1991
agcaacgatcaggaagcccagcccagcccacacaccccaccccacgtccccaccccgccagccggcacaaagcgcggcgttaatatctcccctcccccttgccctcaggtctccccaccgcccccgatccaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgct

SEQ ID NO: 2660 - DNA, 1326 bp, Zea mays
  misc_feature: Ceres CLONE ID no. 1537388
  misc_feature: Encodes the peptide sequence at SEQ ID NO. 1425
  misc_feature: Encodes the peptide sequence at SEQ ID NO. 1928
ccgccactggacttgcgctccctccacgctccggcccttctcgcctctccggccatggccaccgccgccgcggccgtcgcggccaccttccgcaccctgatccagcacgcagcggcttgtggcgcccccgtcccgctccccagcgtccggttccagagcctgcagcgccaccgcgtcggcctccgccgcctcgcgccaccgcgtgggcgccccgtcctaaccccgcccttcgccgccgaggacttctcatcctacgtagatgatttctccggggacgacggcgaggagcacttcgatgaggaagagggctctgaaccggaggaggaagccgaggccccgcgcgcgtactcgtcgccacgaagccgcccaccgcgcggcgacgaccccggccgtctcttcgtcggcaaccttccctacacctatacctccgaggagctcgcccaggtgttctctgaggccggcagggtcgacgacgcgcagataatctacgacaaggtcaccaacaggagccggggcttcgccttcgtcaccatggccaccgccgaggaggccgccaaggccatccagatgttcgatggcgccctgctgggagggaggacggctagggtgaactacccggaggtgccgcgtggcggggagaggagaacagtcaccatgagtggccgcaggcgtgacgatggcacttacaagatttatgccggcaacctggggtggggggtgcgtgccgacacgttgaggaacgtgttcgagggtagggccggcttgctcgacgccagggtcatctttgagcgtgagactggtcgctccagagggtttgggttcgtctccttcagcaccgcagaggatgcacaggctgcattggagtctttggatggagtggaactggaagggaggccgcttcgtcttagtctggcagaacagaacccgccacctggttccccgcctagcactgcgcaggcacagcaggaagaaacggattcaggcgcacctgctggtgcgggtacggaagcagccagttcttcagaaccatctgaagcagaggtgggcgagagcaacttgcaaacagctgcaaattattgataagcaggagccacagggttataaatgtgttgcaacgacctctaaatcctgccattcgagtccaaggtgtgctgatagggaagtaaattttgacacgagtgatgctgtagcgaggattcagcatttgagctatatacatatacactagaatggattaagtgttgttaggaacgtatttgtgtaatgaattctgcaaagtatgatctcaactgcagttgtgtagcctttctcttacagtcttactgt

SEQ ID NO: 2661 - DNA, 1264 bp, Zea mays
  misc_feature: Ceres CLONE ID no. 1540519
  misc_feature: Encodes the peptide sequence at SEQ ID NO. 116
aatcggtcccccgcctctatcctttctctccgcacaaggtgcccctgccgcccagccgccatgaggaagccgacccgacgacgaggaacctcagcgaaaggcagctccggcggcggtatcagtaaggcggcaacactgccggcgaagcagatggtcttgtccggctaccgtggcaccgtagacgcgtttgactgcctccccgacgacctcgtgctcgccgtgttagccggcatcgcggcgcgcgcccggtgccccgccgacctcgctgcggcggcgctaccgtgcaggaggttccgggacctcgcggcgcaccccgccgtgctgtcgcgtgcgtcggcggcggccgtcgccgtgcccgcgggaaggtggtcggatgcggcgcaccggttcttgcggcggtgcgcggcctccggcaacctccacgcctgctacctactcggcatggtgctgttctactgtatcgggggcagagcgacgggggcggcgctactggcgcgctcggcggcgggcgggcacgcggcggcgctgtacgcgctcgccgtggtgcagttcaatggcagtggcggcgacaaggcggacaaggacccccgcgcgggcgtggcgctctgcgcgcgggccgcgtggctcggccacgtccctgcgctccgcgagctcggccactgcctccaggacggctacggcgcgcgccgcgccgccgcaaccggacgctacttcctgctccacgccgccgcacgcgagctcgtctcctcgcactgccgaaacggcgaagacgacgctgccagcaggttcatggcggagtggtgggcgctgccctccaagacaggagcacaaggcgacggcaacgacgccgacgccgacgcgcgcctgtgctcgcacccgcggtgcgggcggcgggagacgcggcggcacgagttccgtcagtgctcggcgtgcgggtccgccatctactgctcgcgcgcgtgccaggcgctccattggaagcgcgcgcaccgtagccagtgcgcggccgcagctagccggtggctcgccgccgggaacgcgcagtaaacgtacgctggccggctggtccacgcaacgccaacgttgcgcatgtacgtaacttgtgaatagtagtagtactaggtagtgccactactacatgttgccatgttggtagctagctttcatttcttgcgttaatgtaaggttaattaaactaggtgattgcatttattttgtaatttttggatcaatcagttgtttgggataaaaaaaaaaaaaaaaa

SEQ ID NO: 2662 - DNA, 858 bp, Zea mays
  misc_feature: Ceres CLONE ID no. 1541168
  misc_feature: Encodes the peptide sequence at SEQ ID NO. 1939
ctctctctctctctctctctctccctttctttcccgcggcgacggtgacgacraccgcgcgagcgccgccractccctactgcatcaggkgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccaagagtatggcatggtatggcggcaggcagccgcaaacttgtttttacctacttggtgtagcgcctgtgtaacagttttcgatcgatcttgcttgttgtgttgtcgatgctaataccgcagtgtaattgacgaaatgactaaaatgaagagtagtgtagtagatgtccaact

SEQ ID NO: 2663 - DNA, 972 bp, Zea mays
  misc_feature: Ceres CLONE ID no. 1548279
  misc_feature: Encodes the peptide sequence at SEQ ID NO. 1995
aaaaaaaaaaaaaaaaaaaaaaaaaaaaaaaaaaagctagtcgcttcgctgccacatctctcctcgtccaaagactccaagctcctgtgcggcctgtgttctgctgccgcctctggtccacatctccccgccgccgccccgtcgtccgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatgtacatttcaactacatatactgttctatacgagttcattttgtcgcaaaaaaaaaaaaaaaa

SEQ ID NO: 2664 - DNA, 766 bp, Zea mays
  misc_feature: Ceres CLONE ID no. 1551497
  misc_feature: Encodes the peptide sequence at SEQ ID NO. 1147
ccactgctatctctcagtagcaagagcaaagcaagaggagagcaagctagcggtaccagggagagtgagcgaagaaggggaaggacgaagaacactgccgaccctattcctagcaacgggccaaagcgaccagctgcaggaaggagaagcagtgttggcgtgttcgagctggtggtgccagaataaatcgggaggaagtgatggcatcgaattcatcggcggcgttctttggtgttagggatggggaccagcaagaccagattaagccgctgatatcaccgcagcaacagctggcagcggcgctgcccggtctggcaggtggtgttcctgcggcgtccggccaaggcgcgccgccggcgcagccaccgcccaagaagaagaggactatgcctgaccccgacgctgaggtgatcgcgctgtcgcccaagacgcttatggcgaccaacaggttcgtgtgcgaggtgtgcaacaaggggttccagcgcgagcagaacctgcagctgcaccggcgcgggcacaacctgccgtggaagctgaagcagaagaacccgctacaggcgcagcggcggcgcgtgtacctgtgcccggagccgacgtgcgtgcaccacgacccggcccgcgccctcggcgacctgacggggatcaagaagcacttctgccgcaagcacggcgagaagaagtggaagtgcgacaagtgctccaagcgctacgccgtgcagtcggactggaaggcgcactccaagatctgcggcacccgtgagtaccg

SEQ ID NO: 2665 - DNA, 1299 bp, Zea mays
  misc_feature: Ceres CLONE ID no. 1555943
  misc_feature: Encodes the peptide sequence at SEQ ID NO. 1180
accgcgcccactcacgcccggccctgccccgcgccctcatcgtctcctcccggcctcccctcaaagcccaccgccgctgcccccacgccacccaccccaccccgcccccgcccctaccgcgcggtgcccgagacccagaggccagacccctttcttcaccttccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccatatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctggtgacctgtggatctatgttgaggaccaagatgtggttgacatggagacggtgtcgagcgagaacctcagacggctgttcatgtacataagcaagctgcctctgattgtcccagacgtcatcttcagtgtgtatgattcccacatcaaatgacttccgacgcgaccttcctgacgaccttcagccagtgcccagctccagttaatcttatgcccccatgtcctccattttcatgctttgctcaagcttttggaagtgcctgaactgatttggaaccgcaagccttccggtggtgctttagaaacttgtttagtgcctgcatgcatccttaatcatatgcagccactctgtacatatctgacttggctcagttaataggggactgtgcttgccccaaatggaggcaaaaaaaaaaaaaaaa

SEQ ID NO: 2666 - DNA, 1070 bp, Zea mays
  misc_feature: Ceres CLONE ID no. 1556085
  misc_feature: Encodes the peptide sequence at SEQ ID NO. 587
aaaaggccaggccaccactccttacctttacctctcttttttttccttcattcacgaatcccttcttccgccttcttcgtcgggccatcctcaccgacgagaagagatctcctcttcggcacgaggaggacagcaggggagaaagatgggggggcgggtggatcacgagtactcttacctgttcaagatggtgctcatcggggacagcggcgtcggcaagtccaatatcctctctcgcttcacgcgcaaccacttctccctcgactccaagtccaccatcggcgtcgagttcgccaccaagtccctacagattgacggcaaaacaataaaggctcagatctgggacacagctgggcaggaaaggtaccgtgcgattacaagcgcctactaccgtggcgccgtggccgccctgcttgtgtacgacatcacgaagaggcagagcttcgacaacgttcacaggtggcttcgtgagctccgcgaccacgctgactccagcatcgtgatcatgatggtgggcaacaaatccgacctgatccacttgagagctatctctgaggacgaaggcaaagcgttggctgagaaggaagggctgttcttcctcgagacgtcagctatggaggccatcaacgtggaggaagccttccagactattatcacggaggtgtatggcatcgtcaacaggaaagcgctggccgccaaggaagcagcagccacagctgccccattgccttcacagggcaaaaccatcagcattgacagcaatgcaggaaatacaaagaaggcatgctgctctacatgaataaaaaagatgtaacctttttaaaatatggtagaaaatggagcatatatagtcatcataaaatatggtgtggaggcgatattataactactgctattctattcttttcttttctttaatttttttttgtgtgtggacaaaatcgagtacatgcagtgtttctgaatcaaaagttagatattgtattaggattcataccttttatgttctccaagttgaatggtactactgcagaatcatagtccaatgttactgaaaaaaaaaaaaaaaa

SEQ ID NO: 2667 - DNA, 644 bp, Zea mays
  misc_feature: Ceres CLONE ID no. 1561415
  misc_feature: Encodes the peptide sequence at SEQ ID NO. 1226
gaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttatttttgttgtagacagcaacgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctgg

SEQ ID NO: 2668 - DNA, 1673 bp, Zea mays
  misc_feature: Ceres CLONE ID no. 1562064
  misc_feature: Encodes the peptide sequence at SEQ ID NO. 1119
aagtccaaagccccttgccttctatccctttcacacacgcctctccttccctctctctctctctatcttcctgcctgaggcagcagccatttccgcttccgatcgtggaggcttggtgtggaaggaggaaaggaggccagctgctggttttcggtgcggcggagatgtctgaggtgtcggtgataaaccaggcggaggtggaggatgcgggtgccgggcagctggacctgccgccggggttccgcttccaccccaccgacgaggagatcatctcgcactacctcgcccataaggccctcaaccaccgcttcgtctccggtgtcatcggcgaggtcgacctcaacaagtgcgagccatgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcgcgccgcgcggggagaagaccggctgggtcatgcacgagttccgcctcgagggcaagcttcccgagcggctcccgcgctccgccaaggacgagtgggccgtgtgcaaggtgttcaacaaggagctggcggcgaggaccgagccaataatggcggcggccggcgcgggcgagctcgagcgcgtcggctcgctgggcttcctcagcgagctcctcgactccgccgagctgccggccctcatcggcgccgacgtcgacgaggtgatcgacttcaacggccccgcgtccacctccggcgcgccgggcacgagccacagccacctcccggtcaagatggaggagcacgcgctgctgcacatgcagtaccagccgccgccgcccccgacgtcctactactcgagccagtacttctctctgccggcgatgaactccggcgacgtccttcccccggcgatccggaggtactgcaaggcggagcagcaggtggtgtcggggcagacggcggcgtcggaggtcagcccgtcccgcgagaccgggctgagcgccgaccccaacgcggagatctcgtcggcggtgaccccgtcgtcgtcgcaccagttcctgcccgagttcgacgacccggtcctgaacctcgcggacctctggaagtactgaagccttcccctggacggctggacgacgatcgatcggtggatcggggcgcccgcccacccgcctcgatcccatggtttggttggttaattgcttgatgattcgattgattatcttggcctgttgtgggatttggggttagtgacggaccgtgacgcgtcctccgcctctactgacctcggggtctgactagattattgcccgtgcagaccggcaggggattagggcccccctccttgttaatgaatccgcccccatcctaggttccttgtcttggtcactgtacatagcgccctactctgattgtgtcagtagcagtagcatgattattgataggattaatgaaatggggggtagattagcgtcagcagtgcgttattacagggcaaagtctacggatgattagtgaatttgggcgcttgatgagccagctagcgccagcttcaaaagaaaaaaaaaaaaaaa

SEQ ID NO: 2669 - DNA, 612 bp, Zea mays
  misc_feature: Ceres CLONE ID no. 1564140
  misc_feature: Encodes the peptide sequence at SEQ ID NO. 1115
agtccaagcccccttgccttctttctcagcccacctctctctttcacgcacgcctctctctctctccctctccctatctgtcttcctgcctgaggcagccatttcctcttccgatcgtggagaggcttggagtggaaggaggctgctggttctcggcacggcggagatgtctgaggtgtcggtgataaaccaggcggaggtggaggacgcgggcgccgggcagctgatggacctgccgccgggcttccgcttccaccccaccgacgaggagatcatctcgcactacctcacccacaaggccctcgaccaccgcttcgtctccggcgtcatcggcgaggtcgacctcaacaggatcgagccatgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcgcgccgcgcggggagaagaccggatgggtcatgcacgagttccgcct

SEQ ID NO: 2670 - DNA, 2313 bp, Zea mays
  misc_feature: Ceres CLONE ID no. 1571937
  misc_feature: Encodes the peptide sequence at SEQ ID NO. 1977
aaaatccccgggccaccactacctgcctgcccgtgcccacgcttcttctcttctcctccccaagccccagccccagccccagctaccgcgccccctcctgtctgttcctgttccaccagcgtcggcctagctacctggccgtcccctctccgagtacgtgtcggaagcctcagctgaaggatctggcctgggcgcccagccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggatgcccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacatctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgttacaacacctacgccattgatctgatgatcacagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcactcgctatctcaggcagtgaggtggaggaggagcatctaggcgtcgtcccaggggaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccggcttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatcaaaaaaaaaaaaaaa

SEQ ID NO: 2671 - DNA, 2020 bp, Zea mays
  misc_feature: Ceres CLONE ID no. 1579587
  misc_feature: Encodes the peptide sequence at SEQ ID NO. 1442
aggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgagcaaaaaaaaaaaaaaaa

SEQ ID NO: 2672 - DNA, 2518 bp, Zea mays
  misc_feature: Ceres CLONE ID no. 1580901
  misc_feature: Encodes the peptide sequence at SEQ ID NO. 950
aattgctcctccattaatcctaacacaccgttgccaaggtttcgacgatccggccacgctacccttccgtcgctcctccggtcctccccacccacgacccctgccggaagggcaaaaggggctcgaaatcggtcccctgatccaggagccaatcttctagttctcccaaatccttttccggatccgaactgcaagtcctccttcgcgaccatggatccacgcgccaggtatccttcgggcatgggcaacggccgcggtgggacccctaactactacggccgcggcccaccgccgcaacagccgcatcagcaccaccaccagcagcagcagcagacatcgggggcgcatcaccaccagcagtacgcgcagaggcagcagcaacagcaccgccacagccacaaccaccagcagcaacagcagcagcaccagagtcagcagcagcagcagcagtggctgcggcggaatcagattgcccgcgaggccgcgggcgcagccgtgaccagcgagccgaaggccctggcgccatccacggccgccgacggcgtcaattcgagttcgcaagattggaagacccaattgaagcttccgcctcctgatacacgctacaggacagaggatgttacagccaccaagggaaatgagtttgaagactattttctcaagcgtgaactcctaatgggtatttacgaaaagggatttgaaagaccctctcctattcaagaggaaagcattcctattgctttaactggtagtgacattcttgcaagagcgaagaatggaactggcaagactgctgcattttgtattcctgcactggaaaagattgatcaagaaaaaaatgctattcaagttgttatattggttcccacaagggaattggctctacaaacatcacaagtttgtaaagagcttggtaaacatttgaagatccaagttatggtcaccactggtggaaccagcttgaaggatgatattgttcgtctgtaccaacctgtgcacttaattgttggaacacctggccgtattttggatcttacaaagaaaggtgtttgcattttgaaggactgttcaatgcttattatggatgaggcagacaagcttctctctcctgagtttcaaccttccatagaacagttgattcgctacctccctgctagtcgacagattttgatgttctcagcgacattccctgtgactgttaaggagttcaaggacaaatatcttcctaaaccttatgtgattaaccttatggatgaacttacactgaagggaattacgcagttctatgcttttgttgaagaacgacagaaagttcactgtctcaacaccctcttttccaagcttcaaatcaatcagtcaataatattctgtaactctgtaaatcgtgttgaactattggcgaagaagatcacagagcttggttattcttgcttctatattcatgcaaagatgctacaggaccaccgcaatagagttttccatgatttccgtaatggagcgtgcaggaatcttgtttgtactgatctttttacaaggggaatagatattcaagctgtgaatgttgttatcaattttgatttccccaagaactctgaaacatatctccacagggttggtagatctgggagatttggccaccttggtctggccgttaatttgatcacctatgaggatcggtttaacttgtataggattgaacaagagcttgggactgaaataaaaccaattcctcctcagatagaccaggctatatattgccaatgatcaggcagttttcatctttgttcatttctccgtgattaataaggagacaacttttgtaaataccagctcatcaggttttatggtgttgatctcatttggtgcatcggagacaattctaagttggttgattacgtgagacgaggcacccgacttttcctgatcaccttgtcatgctgacactattatggctatatgggggaaaatgtcctgccacactaggcacaaagtagtgtatattgctaggtgcctattcctagaccctgtcctgctttgagttcgtttgtatttcccttgttttccgtacgccgtgtcgttaagcagtttcacacaggacattttaaccctgttgctggttctgggcgtgtggcctgtgggtgccgcgcacaagggtaaaagacattttagcccaagtggaacttggggatgtgcgcctcagattggttaatgggtgtgacaagtcggccatcgcacttgaggtctggagtctgaacggtagtgaagtggttttaagtttgccaataatcggtggtaagctgcaccgtgctgtgctgtcttttacccttgcaaccatgtccctttgcttcttggcatggtcgccatttagattctgtccggcgaatgtaacgctgggataaaacgttcttgtcgtttgtgatggatttatgtgtttggcacaagcaacttggccaggttatgggtaccagaactgtctacttgtttcttccataataacaaactttgcagctccaaaatt

SEQ ID NO: 2673 - DNA, 2028 bp, Zea mays
  misc_feature: Ceres CLONE ID no. 1585988
  misc_feature: Encodes the peptide sequence at SEQ ID NO. 2014
aagggccctgcagcggcggcagctggcgggagagaggcttgggactgggccgcccggccgcgaggaataaactcactcctgtcttcatacgtatccatagccggcaggcggcagtacctgtatgtggttttagctatacgcgacctcagttcgggcgcaaggttagtcttcgatttaagcatagattttattttatcttcttggctccaccaaataacactaacaaaatcgctttggcttctatgggttcaaattaagcactggatcgtaccattttcttgttcatttatactttgtcatccaatccacaccgattaatttctcacggtcaacaacgcatgaagttttcatttctgggaagaagcatgtattttttttatctccgactcgatctagtggtgagaggaggaagatgaatagtgcatgcatatgatatctagagaggcaccagatctagtggctccatgttctgttcgcgggctaagaaaaaacataaacaagcaggcgcctgaaaaatagctagtccctaactttttagaccaatctgtatgtttattttgacgatattggtatgaaaaagtctctcaagaacaatatacatatgcagcatgcatgtgcatggtataattataaattattagcagagtttagataagtaggcccccacgtctgcgctccgccacctacagcgagcctccctttcctccctccctgattcgtttgcacttgctgagagctcaacagaatttggtcaccgatttcaattcgcagctactaattctcaccacattgaaattttcgatttgaaacagtacaatttctgaagagaaattgtacgtctgaaacggttgcatgtgtactatgaactgctagccattccctgcatacgtgggacacgctcagatcattcattcgcagcacgtacgtaaccttaatattctactatacatccatgcagctacaaccccgaccaggcgagaagaagcatcgatagtgtgacgagctaacccaccaccagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatactctacagcaaacgtggtaatggagctgctatgcatacagaacgaataaggcgtgacgtgtgagaccgtaagagtacgtagtactaatatgtagatgcacgtgacgtgccaattaatcaaagattaacatgcagttaattaattagtcctcctaaaaaaaaaaaaaaaaa

SEQ ID NO: 2674 - DNA, 642 bp, Parthenium argentatum
  misc_feature: Ceres CLONE ID no. 1603975
  misc_feature: Encodes the peptide sequence at SEQ ID NO. 1127
aaacgctctccctcatctttttttttaaattccccttcatctcttttctttaacagtttaacctatttgtctaacaccttcttcataacttgccattaacatggttggaagggataactctaatctcccaccgggttttcggtttcatccgaccgatgaagaattgatcatgttttacttacgcaaccaagcgttatcaaaaccttgtcctgtttctattatacccaaggttgatatttacaagtttgatccttgggagttgcctgagaaaaccgaatttggtgagaaggaatggtacttctttactcctcgcgatagaaaataccctaacgggattcggcccaatagagcggctgtatcgggctattggaaggcgactgggacggataaagcaatctatagcggatcaaaatatgttggtgtaaagaaagccttggtgttctacaaaggtagacctccaaagggtaccaagaccgattggattatgcatgaatatcgattgaatgagtcaagatcacaacccactaagaaatttgggtccatgaggttggatgattgggtttttatgtagaatttacaagaaaaagagtgctgaaagaccattgggaccaaggagaagaaatttataatacccaaaatgcc

SEQ ID NO: 2675 - DNA, 583 bp, Glycine max
  misc_feature: Ceres CLONE ID no. 1617036
  misc_feature: Encodes the peptide sequence at SEQ ID NO. 176
acaccacagaaactgaaaagaaaaacttactcgagaaaatgtctggaaaggcgaagaggagagacgacgacgatgcttccgacgccgactccgaaggccacgcgccgcccatgaagtccctcaagaaggattccgacgacgatcccgactctgttaccatttgcgaaatttcgaagaacaggagggttgccgtgaggaactggaaaggcagcattatggttgacattcgcgagttttacgtcaaagatggcaagcaattgcctggcaggaaaggtatctcgttgaccatggatcagtggaatgtgcttcgtaatcatgttgaagaaattgacaaggcagttaatgagaattcttaggaagtgggcatctagtcaatttaatagtttactatgatagcaggttatatatatagtctttttggatgatttgaagtacagttaagggctacagtattttgtctgatcaaacccttcgaggttgctattgtaggatttcgatttcagcctctggttactaatgcatgtaaagtgacctctattatatatgctagtagttggttaactaaaaaaaaaaaaaaaaaaaa

SEQ ID NO: 2676 - DNA, 528 bp, Glycine max
  misc_feature: Ceres CLONE ID no. 1618178
  misc_feature: Encodes the peptide sequence at SEQ ID NO. 551
aaaaaaacctcttgttgagagttgaaacacacctactacaattgctaaagtcctttcttgtcatagcaaaaatgaagcttgtctttgccaccctactgttatgttctcttcttctaagctcctctttcttggagccagtcatcgcctatgaagactcgtcttattgcagcaacaagtgttcggacagatgctcatcggcaggggttaaggataggtgtctgaggtactgtggaatatgctgtgctgagtgcaaatgtgttccttctgggacctatgggaacaagcaccagtgtccttgctacagggacaagctcaacaagaagggcaagcccaaatgcccatgaagtcttgaactcaaagaccaagtcacatagagacttaagagaataagactggtgtttgtgtttacaattacatcgtgaattcccaagcataatggttggactcttgtttccaatgtctgttggatatatgttagatctgaacgggaataaattacatatcttggatgaaaaaaaaaaaaaaaaa

SEQ ID NO: 2677 - DNA, 1191 bp, Glycine max
  misc_feature: Ceres CLONE ID no. 1619846
  misc_feature: Encodes the peptide sequence at SEQ ID NO. 672
  misc_feature: Encodes the peptide sequence at SEQ ID NO. 739
aatcaaaacccctctctctcttatctctctcttccattaccttccttcactcttacgtctatcgctttcacctctctctctctctctctctctctctctctctctctcttcgattttgattttgggtttattttttcccccttttcaattttgttcatggtgttgagcgtgtcacggtaattggcgggaagtaaccgtcaattccgataaccctttggtgaaaagcttgaaacttgaggagtttgaagaaaagggggtttatcgtttcgtcgtggatgatggcgaacccatctggcaaccatcaagagcacacgcacgtggtgtcgtcttctgctccagagacttcaggtgcggctctcgcgatgaagcacaatcctggcatatccctcgattggaccgcagaagaacaagccattctcgaagatggactctccaagtatgcctcagaatccaacatagtacgctatgcaaagatagccctacagctacagcaaaaaacggttcgtgatgtagcactgcgagtcaggtggatgaataagaaagaaaatagcaagagaaggaaggatgatcataatttaactcggaaaagtaaagataaaaaggaaagggtttctgatcccgcagtaaagtcatctaactttgttgctcggtccaatgtctccccatatgctccaccaatgattgcaatggacaatgatgatggcatctcttatacagcaattggaggtcccaccggtgacctattagagcaaaatgcacaggccttgaatcaaatctccacaaatctttctgctttccaggtacaggagaacatcaatcttttctgccaaactagagataacatccttaaaattatgaacgagttgaatgactcgccagaggtgatgaagcaaatgccacctcttcctgtgaaggtgaatgaagagctagccaattccatactcccaagaacaaatcttccaccacaatcatgaattcatgataaacattcatacttaaccaggcttgcctcttgaatatttctgcctgcacctctgatcaggagaataactgccaaatgccaatcaagttgaccccaagatttacttttggaaaaaaagaaagaatgaataattgttgataatcatcaagttgaattagtttcaataattttattttattttatttttccaaaaaaaaaaaaaaaaaaaa

SEQ ID NO: 2678 - DNA, 333 bp, Glycine max
  misc_feature: Ceres CLONE ID no. 1620054
  misc_feature: Encodes the peptide sequence at SEQ ID NO. 175
acacagaagaaaaagacttactcaagaagcttcgagaaaatgtctggaaaagcgaagaggagagatgacgacggtgcttccgacgccgactctgaaggccacgcgccgcccaagaagtccctcaagaaggattccgatgacgatcccgactctattaccgtttgcgagatttcgaagaacaggagggttgccgtgaggaactggaaaggcagcattatggttgacattcgcgagttttacgtcaaagatggcaagcaattgcctggcagaaaaggtatctctttgaccatggatcagtggaatgtgcttcgtaatcatgttgaagaaattgac

SEQ ID NO: 2679 - DNA, 494 bp, Papaver somniferum
  misc_feature: Ceres CLONE ID no. 1620744
  misc_feature: Encodes the peptide sequence at SEQ ID NO. 693
  misc_feature (470)..(470): n is a, c, t, g, unknown, or other
atactcgattctctctgctctccttcttcacttgcttctttactcagccatttgatcatcgatttcctctcttttcttaaggtgattgtattcctctttgactagtttcgggaccttaccggtgttgaaatgaagggtgcgaagggaaaggggacagtgaaggacaaaaaagaagtgttgaagcctgtagacgacaaaagggttggaaagcggaaagcggctactaagacagaaagcagtagcaaaaaacagacgaaaaagggaaagttggccagcaaagaccctaacaaaccaaagaagcccgctagtgcctttttcgtgttcatggaggagtttaggaagacttacaaactagagaaccctgacgtgaaaggcgtagcagcagttggggaagctggtggggaaaagtggaagtcccttttctatgcggagaaagccccgtatgaagctaaagctgccaaaaggaatcngaaatatgaaaggtcatggctgat

SEQ ID NO: 2680 - DNA, 946 bp, Glycine max
  misc_feature: Ceres CLONE ID no. 1625939
  misc_feature: Encodes the peptide sequence at SEQ ID NO. 871
attccacacagcatttaagaaactcaagagatagaaagaaaataaagagaaggagaagagaagaagagaaaggttgtgagagatatggggaggggtaagattgagatcaaaaggattgagaactcaagcaacaggcaagttacctactcaaagaggaagaatgggatcctcaagaaggcaaaggaaattagtgttctatgtgatgctcaagtttcccttatcatctttggtgtctccgggaagatgcatgaatacatcagcccctacaccacgttgattgacgttctggacagataccaaagagcttctgggaagaccctctgggatgctaagcatgagaacctcagcaatgaaattgatagactcaagaaagagaatgacagcatgcaaattgagctcaggcacttgaaaggggaggacatcacgtcactcaattacaaggaactgatggcactagaggatgcccttgaaaatggcctcagtggagtccgtgagaaaaagatggaagtgcacaggatgttcaagagaaatggcaagattttggaggagcaaaataaggaactcagtttccttctgcaacagcatttggcagtagaaggaattggaaacatgcatgaacaatggatttgacgagatcaaaaggggattcaattcgcatatgcaacgcgcagctagcctaaaacagccaaatctaaaagaattattgaattcgtatttcttaaagctcggtagtgtacgtagctctaaaacttgctatacgattattgaattcgatctaattacgaaactatcaatattatataacgtgtatgctgcatatcattacgattattgagctatatatgttgcatatggagaaatgctaattacttgcatgagtttaatttttatatagtatgaaaaaagaattgctaaaattaaaaaagaaaaaaaaaaaaaaaaaaaa

SEQ ID NO: 2681 - DNA, 1375 bp, Glycine max
  misc_feature: Ceres CLONE ID no. 1649800
  misc_feature: Encodes the peptide sequence at SEQ ID NO. 349
cattccaatgtcaccttctttttgcacatccctcttcctcttcacactctcccttctcttcttcctattcttctccctctccgtctccgcccacagcggccaccacgacgacggtgacgccgactccgacgccacccccgacctccgtgctcggcccttgattctcgcgaaggtgtggtgcctgatcgtgatcttcatcgccaccttcgtctcgggcgtttccccctacattctgaaatggaacgaggggttcttggttctggggacccagtttgctgggggagtgtttctgggaactgccatgatgcattttctcagcgacgctaatgagaccttcggggacttgactcaaaaggagtaccctttcgccttcatgctggcgtgtgcaggctacttgatgaccctcctcgctgatgccgtcatttcctcgcttttcaacaatatggggcgtcatgcccaggatgtccaaggtcaaggggctgatgtgaacaaattaagtagcaacggcgttacttctcaatcacaacaccggagccatgacgctaatcaccatttagcaagtcctgcacttggatatgtccattcagttggagacaccgttttattgattgttgccctttgtgcacattctgtgtttgagggcttagcaattggagttgcagagaccaaagcagatgcatggaaagccttgtggacaatatgtctgcacaagatatttgcagccattgccatgggaattgctctcctaagaatgattcctgaccgtccccttgtgtcgtgtgctgtctatgctttcgcgtttgccatctccagtccaattggtgtggccattggaatcatattggatgccacaacacagggtcacgtggcggattggatctttgctatatcaatgggtctggcttgtggagtgtttatctatgtatcagtaaaccatctgttggcaaaagggtacatgccccacagaccgacaaaggttgactcggcctatttcaagtttcttgctgtgttcttgggtgtgggagtgatagcggtggtaatgatttgggacacctaagtagttccaaaagttggaggcatagtgatagcttagttccaagataacttctctttgcagcatatgcagaatctttttttacttttttctttatctttgtggtaattcctgtggtagaaaagatggcagaaatttgcctcaaatgatagaaaagatgggcatgtattgaaaactaagaggacgtatagaagtcttggtaagaaggttacttcacacagagggtagccaaaatcattagaggcaaaggggaacggagaaggaatatatacaaagctatatagaaaggattttatagatcaaaaaaaaaaaaaaaaaaaa

SEQ ID NO: 2682 - DNA, 1496 bp, Glycine max
  misc_feature: Ceres CLONE ID no. 1662905
  misc_feature: Encodes the peptide sequence at SEQ ID NO. 499
acggcattccttacctcacccaccgcaacacaatacccataaaccaaagccccaacccgactctcttctcatttatcctccctaaagcttcaacctttgggacgcccctcccactttgttttcttctctttcttcattttccttttcggtggggattaggataaccctcctctatttttcaactctaattttgatcatcatcaccttcacccacttcactcttacaaggaagaacaaccctttctctctctctctctctgttctgtgttgattctgtgcttcagctttccacaaagtaaagggaaagatggcaatgattccgtaccacctttgccgtttaccttaccaggattccctcaaagcacttgaagctgatatacagcacgccaatgctttggctgctgcaattcccagagccaagggtggaactcttcttcaaatgaaattggtttacaatcacttggctcctctcttcctgttatttctacaatggatggattgttcttgtgcaggctttctccataggtatctcaacctcttccacatacttgtatacaaggtacataatgatggtagatcaatcatgtctactcatggaaggaaggctaccattggtgacttttatgccgttatattgccatctctccaacggcttcatggtagtttggagaagttggaggttgttgaagaagaagaaggacagtcaagcatagaaggtccaagttatggcaagaaggtcattgaaggtgtgaaactaaccaccaatgttgatttgcaaagagaagatgaatgtggtatttgcttagagccttgcaccaaaatggttttacctggttgctgccatgccatgtgtattaaatgctaccgcaagtggaacagaaagtcagagtcttgtcctttttgccgtggtagcttgaggagagttaattcggaggatctatgggtattaacttgtaatgatgatgttgttgatgctgaaacagtttctaaggaggatttgttgcggttttacctctatatcagcaagcttcctaaagatcacccagatgcacttttcctaatgtattatgaatacctcatttaattttcttctaaataagaagaagaagaaaaaaaatgtacagataggaaattccggactgcaaatgtgaatagagtctggtacaaaaagaaaatactctggtaatttaatcacagttgttatggtaagagaaatttctggttttttagcccagaaaaaccattcttcttacccctgtgatatatctccattgtagaccattgttcttgctattaacttggaagtccttgcataaaggatccattaagttaaatcttcttcttgtatgttagttgttgacacagactgatattgagaagatgaatctgttctgtgtgattgtattggatgttggaaatgtttggatagtatcagaggtaaatttaaataattggtgcttataatttaaaatatatcaaaaaaaaaaaaaaaaaaa

SEQ ID NO: 2683 - DNA, 1396 bp, Zea mays
  misc_feature: Ceres CLONE ID no. 1674566
  misc_feature: Encodes the peptide sequence at SEQ ID NO. 561
agctccattccctcactgcccagttgggcggccttcaaaacgcagcctctctctctctctctctctgtaagacgggaaactccagcacatagtaattggtaactagctaggtagaagaagatgagctcgtcgatcagcatgatggaagcgagaatgcctccgggtttcaggttccaccccagggatgacgagctcgtgatggactacctcctacaaaagctctccggccatggccaccacgccggcgctgccatcgtcgtcgacgtcgacctcaacaagtgcgagccatgggacctcccagattccgcgtgcgtgggtgggaaggagtggtacttcttcagcctgcgcgaccgcaagtacgcgacggggcagcgcaccaaccgcgccacgcactccggctactggaaggccaccggcaaggaccgcgccgtcgtcgccggcggcgaggatgcggtggcggtggggatgcgcaagacgctggtcttctaccggggccgcgcgcccagggggaggaagacggagtgggtcatgcacgagttccgcctccacccccatgccgcgccgtgcctgctaccagcagctgcggcaaacaaggaggactgggtgctatgcagggtgttctacaagagcagaacaaccacgccaaggccagaatctgaagacgcccgggacggcaccccatcagctgagtcgcaactgccggctgccctgccgcttgcgcccctcgctgacacctacgccgccccaacggttgcagagaaggtgtactgcttatccggtctgccggaactgccattcagaagaccagtgagccttggggaccttctggcgttcgaggcatctgagaaggagtctgtcacgacagtgatgaccagtgtctcgaacaacactagttcagtgctggagctgactccaaattgcaactggaaccaggaaaatggcatgtcacggatgtggagcccccttgggatatgagatagatctgtgttgtttgctggatctggatgtatggagtcttagtactgagtggccagtagggttctgctgcttagatttgattagcagtgtgacttgcagattgtgtagattagattatccgttattggactaatggcttggcgtagtatttgtacatattgctactgaaggaacagtgtccttatccttgtttggcgtagtatttgtacatagcacctgctaaacttcagacaatcagtgaaagacaaatgtgtacattgtaacatagtgttaagaaactctgagagttgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2684 - DNA, 558 bp, Musa acuminata
  misc_feature: Ceres CLONE ID no. 1716210
  misc_feature: Encodes the peptide sequence at SEQ ID NO. 653
attttcttcctcctccaccaattccgtcttcgaggtactctgcgatgctcttggggttggcgtttcttgtgatccggatttgtgacttcttcctttttattcctactgacgcgttcttttgggggttaatttggtttctagggtttccggagcggcatatcttccatggattccgcgtcttcaggacagccggagttcgattatttgtttaagctgttgctgattggggattcgggcgtgggtaagagcagtctcctcttgaggttcacttcggactccttcgaggatctttcgcctacaattggcgttgacttcaaagtaaagattgttaacattggtggaaaaaggctgaagcttgctatctgggatacagctggacaggaacgattcaggactttaacaagttcatattacagaggagcacaaggagtcattatggtttatgatgtaacacggagggacacattcacaaatctttctgacatatgggctaaggaaatagaactttattcaactaatcaggattgcattaagatgcttgttgggaacaaggttgat

SEQ ID NO: 2685 - DNA, 563 bp, Musa acuminata
  misc_feature: Ceres CLONE ID no. 1723374
  misc_feature: Encodes the peptide sequence at SEQ ID NO. 711
acacagatcagctagctccaccagagaagcaaagcaaacccttcttccctgagatggcatccggttcgatgagctcctcctggaccgcgaaggagaacaagatgttcgagaaggcactggcggtgtacgacagggacacccccgaccgctggcacaagatcgcccgggccatcggcgggaagacggcggacgaagtgaagcgctactacgacctgctcgtggaggacgtgcgccgcatcgaggctggccaaatgccgtacgccaattaccggtcctctaatggcagaggttgagagtgtttggagctcaaccggagaacgaacaagaagcaaggagcatttcactgttctggatatcagttaccacaatcttaattataggactatatgaactctacatgtctgtggacttacaagtagtttcttctatgcagtcttctttctcccttctatcgtgtactcccagatatatcgaagactgccatcataaacatatatatggctagtcttcttgtaatcggttatcttgcttgctaatgaacgcttagtattgttctattctag

SEQ ID NO: 2686 - DNA, 1068 bp, Musa acuminata
  misc_feature: Ceres CLONE ID no. 1725800
  misc_feature: Encodes the peptide sequence at SEQ ID NO. 1025
atttcctcctcttcaaacccctctcaacgggcacggcgacccaaacaagtcttcttcttctcgataccttcacatccgagatctcaaagccttcctcctcttctttccgccgggaaatctcggagggaggggggatctgtggccgtggcgtaggattagggattctcgatccctcgatcggtctgtttttcctctatattttgggtgtttcgttgtgattggcgatggctgctccacctgttagggctcgggccgactacgattacctcatcaagcttctcctgatcggcgacagcggtgttgggaagagttgcctccttttgcgtttctctgacggctctttcacaacaagtttcattactactataggtattgattttaagattagaactattgagctggatggcaagcggattaaacttcaaatttgggatactgctggtcaggagcgctttagaactataacaactgcttactatagaggcgctatgggtattttgcttgtctatgatgttactgatgagtcatcttttaacaatataaggaattggattcgcaacattgaacagcatgcttctgataacgttaacaagattctcgttggtaacaaggctgacatggatgaaagcaaacgggctgtgccgactgcaaagggacaagcacttgctgatgaatatggaatcaagttttttgaaactagtgcaaagacaaacctaaacgtggaacaggtcttcttttcaatagctagagatatcaagcaaagacttgcagaaactgattccaaacctgaggatcgaacaatcaagattaacaaaccagaccaggcagctgctgagggtactgcagcaccgagatcagcatgttgtgggtcttagtgaccagtgaggttgtgatgaatagaatgttgttgggaactaaaatgtttgtcatacgtaactggtgctatgaatataaggaagatatgacgaccctacttgtaattttaattcttctatttattttcgttacattggttcttaggctggtgaactattctgtcattctttctcttttatgtacggtcttccg

SEQ ID NO: 2687 - DNA, 1226 bp, Musa acuminata
  misc_feature: Ceres CLONE ID no. 1728175
  misc_feature: Encodes the peptide sequence at SEQ ID NO. 623
attcgtttggttgctgtgtgggtggattaggttttggcttccgttccagataagtgttctttgtctcctttctttctctgtttcctttccttttctgaagggttagttcctttctttggtttctgtggcttttggtttatccttggctgggatccttcttaggcgacacctccgggtttaaaatctgatctttcggggtagattttggcttttgggttgttgtcttttagccccgatcctcagaatccgatctttggaatcgacccttccgtttagagagcttgcgcttctcaaaatctgttatttggaggccaatcttttcttgaaagatctgttatttcggtgttggtctttgttcttgcaagtaattagagggggctgatgatcttgatgttttcgtctctaattctgtcgaaaaccagtttctaccctttatgaatcttgctactctcagcgtctgcttcctccactccttctccgtggtcctcctctactggttctatgtgatctcatgaactaagtctctttgcgtgatccagtcatttcatttcatttttttccgttcaaaccaatttctattagcttagaatcagagaaccacccctgctaaagagtatgtcttccattccggtccgccgcgcttcgagttctgaaggagactcgcagccgacgtccgatgagaggaagagaaagaggatgctttcgaacagggagtccgcaagaaggtctaggatgaggaagcagcagcatctcgatgatctgataaaccaagccgagcagctcaagaaccaaaacagccagatcgacgtgcagatcaatctggcgacacagcagtacgtcaaggtggaatctgagaacgctattctaagggctcagctgagtgaattgacagagagactgcactcgatcaactctgttctccgtttcattgaggaggtcagtggaatggccatggacataccggagataccagatcctctcctgaagccattgcagcttccccgtgcggcacaaccaatcatggccaatgctgacatgttgcagttctgaaatgtcattgttgtgtaaggtctatctagcatgtgtctccattgattgggctattagttccttgttttgctgcttatgctttcatcttgttgagtcgcagtaaattagctttttctttggttcgagtcagtaagtgatgtatggttgtgtgcttattgtaattttacctttaagcg

SEQ ID NO: 2688 - DNA, 727 bp, Musa acuminata
  misc_feature: Ceres CLONE ID no. 1728645
  misc_feature: Encodes the peptide sequence at SEQ ID NO. 1100
acaccctttccgattggctttcctctccaagaggctgaactgtgacacgacttccttctgaagctttcggtccaaagctgagaagcccccctgagagaagtaaggaagaagatggcggcagaagggagtcgcacggtggggatcgggatggactactcaccgacgagcaaagtggcagtccgatgggccgtcgacaacctcgtctgcgccggtgaccatgtcgtgctgattcatgtcctgtccaagtctgatcaccacacggagaagcagctttgggaagaacatggatcacctctgattcctcttggtgaatttgaggacatgaacctgacggtgcgatatgggatcagcccggacggcgaggtcttggatatcctgcacactgcatccgagaccaaaggggtgaaagtggtctcgaagatctactggggcgatccgagggagaagatctgtgatgcagtggaggaactgaagctggactcactcgtggtcgggagcaggggcttaggagccattaaaagagtgctgctcgggagcgttagcaactacgtcgtcgtccacgcgacctgcccggtcacggttgtgaagtcgaatgcctgattcgctgtggcgttctccctaagacaaacctgtttgcttgctttggtggatgaacatttagctcctcgtgctttacttgctttctttggacaataagcttcagtgagcaaatattaccgatttaacg

SEQ ID NO: 2689 - DNA, 751 bp, Musa acuminata
  misc_feature: Ceres CLONE ID no. 1734621
  misc_feature: Encodes the peptide sequence at SEQ ID NO. 455
gtgcgcccacctctttccttcaccaccctctctctcctcgcctctatctctctcctgctcctcccctatattacgatccagcctggtatcgacgctcttcccgtcccgtggagcaaagccggaaccatctgtaccctttgtctttctattgtctcaccgtcattgattcgattcggaggcaccggtcgtaacggatttgactttgttcttgttgttcttccccaaagatcgaccgagaagacaagaggatggcggaggagcagcgatgccaggagggccaccgcctctgcgctaacaactgtggattcctcgggagccctgcgacgctcaacctctgccccaaatgctaccgcgaccaccgccttaaggaggagcagcagcggcaggacgcctcgcacgcggccaacgtagccgccgccgagaaacccccccacgcgtcctcctcggcctcggtcgtggcgtccccggccgggaacgcgagagggcccccggcgctggcctctccggcggtcgcggcggcggcggcgggaccgagccggtgcgcgatgtgccggaagagggtgggcctgacggggttccggtgccggtgcggggccacccactgcggggcacaccggcacgcggagcagcacagctgcaccttcgacttcaaggcggccggccgggaggccatcacccgcgccaaccccgtcgtcaaggccgacaagctcaacaggatctgaagaatccccaccctccgtttctccctgct

SEQ ID NO: 2690 - DNA, 1155 bp, Populus balsamifera subsp. trichocarpa
  misc_feature: Ceres ANNOT ID no. 1538994
  misc_feature: Encodes the peptide sequence at SEQ ID NO. 1747
atggttagcagtgatatggataaaactgggaaggaaaaggaggccaagccaccatctgctgctcctacacaggagcagccttcaactgccagtgctacaactgtaaatccagactggtctgggtttcaggcatattctcctatacctccacctgggttcttggcatcaagtccccaagctcacccgtatatgtggggggttcagcacatcatgcctccctatggtaccccaccacatccatatgtggcaatgtatccgcatggtgtatatgctcatccatccattcctccgggttcttatccttttagtccttttgcaatgccttctccaaatggtattgctgaggcttctggaaacactcctggcagcatggaagcagatggtaggccatctgatgctaaggaaaaactgccaattaaaagatcgaaaggaagtttgggcagtttaaacatgatcactgggaagaacaatgagcatggtaaaacaacaggagtgtctgccaacggagcttattctaagagtgctgagagtggtagtgaaggctccagtgaaggaagtgatgcaaattctcagagtgactcacaaatgaagtcaggtggcaggcaagattctctggaagcacatggtgctcagaatggaggacagggtgcatctaatacgatcatgaatcaaacgatggctatcatgccaatatctgctgccagtgctccaggagctatacctggccccacaaccaacttaaatattggaatggactactggggagcccctgcttcatctactgttcctgcaattcgtgggaaagttccttctactccagttgctggaggggtagtttctactggatcacgggatggtgttcaatcgcagatttggttacaggatgaaagagagcttaagagacagagaaggaagcagtcaaacagagaatccgctcgccggtccaggttgcgtaaacaggctgaatgtgatgaactggcccaacgtgctgaagccttaaaagaagaaaatgccaatcttagatcagaagtaaaccaaatcaagagcgagtatgagcaacttcttgcggagaacgcctctctcaaggaagattttagggctggcaggaatgaccaacatatgagcaatgatacacaacagactggacaaacatag

SEQ ID NO: 2691 - DNA, 869 bp, Glycine max; identical to SEQ ID NO: 1751
  misc_feature: Ceres CDNA ID no. 23401690
  misc_feature: Encodes the peptide sequence at SEQ ID NO. 1638

SEQ ID NO: 2692 - DNA, 1548 bp, Zea mays
  misc_feature: Ceres CLONE ID no. 230342
  misc_feature: Encodes the peptide sequence at SEQ ID NO. 826
  misc_feature: Encodes the peptide sequence at SEQ ID NO. 1934
acgtctagtaaatctgaagcaaagaacaagcggcgaggtgcaccgtgcacctccagctctgacctgctcggtcgcccgtgtcttcgtcttccttaatctcgaattccgaatcctcctccaacacctcgttttcctggattatccagcgagggacgccggtttgttgctcgtcctcctccctggttgcccgaggcggcggtggcggggcgaccatgtacagatcggcgggggtcgcgatggcgtggaacgtgttccggttctgcacggctctgcgtgggctaggttccatcatgatcctgctcgtcctcgcgatcgtcggcgtcacctactacgctgtcgtcctctgcaactacggccccgccctgttcaccggcggcggcaccactctcgccgcgctcgccgtcctgctctccttccacttcctgcttgctatgcttttatggagttatttttctgtcgtgttcacggaccctggttctgttccaccaaattggaatcttgattttgatgtggagatgggagaaactgctcctcttgctagctcagagctctgtagccagatgaactcacagcaatctgtggctcttggcaatatgacaaatccaagggttaggtactgtaggaagtgcaaccagttgaagccacctcggtgccaccattgctctgtttgtggaagatgtgttcttaagatggatcatcattgtgtgtgggttgttaattgtgttggggcgctgaactacaaatactttcttctcttcctgttttacaccttcctcgagacaactcttgtcactctctctctattgcctcacttcattgccttcttcagtgatgccgagatcccaggaagtcctgcagcacttgcaaccacatttctcacctttgtgttgaatctggccttttctttgagcgttcttggttttatgattatgcatatttcacttgtttctgctaatacaacaacaattgaggcatatgagaagaagacaactccacattggatatatgatcttggccggaagaggaattttgctcaggtttttggaaatgacagaaaatattggttcatccctgcatactcagaagaggatttgagaagaactccagctctacagggtctggattatcctgtgagaccagattttgatggtcaggaactgtaacacagcaatttttgccagtgtcctcgtcagatacctcagtgttggacatctactgatacaactgacagcattgctgattgcgctatgcaaggcatcaaatgaaatgttcacaagattttagtaaccatgagtaattcatctgttgcacgtcatgtatgtgacgaagtgaaatttctcctagctgggccagaggaagtttgttgggatgtaaattagttttatcgacaacgtggattggtttcattccatccaaactggtagtgtgcttcaaatagtgctgtactttagtttagttattattatgtgatataaatatcatttctgataattgtgcctctgttatacactatcaatagtaaatggataagcgctgtgtaattctttc
